US012760292B2

(12) United States Patent
Liu et al.

(10) Patent No.: US 12,760,292 B2

(45) Date of Patent: Oct. 13, 2026

(54) BASE EDITORS, COMPOSITIONS, AND METHODS FOR MODIFYING THE MITOCHONDRIAL GENOME

(71) Applicants: The Broad Institute, Inc., Cambridge, MA (US); University of Washington, Seattle, WA (US); President and Fellows of Harvard College, Cambridge, MA (US)

(72) Inventors: David R. Liu, Cambridge, MA (US); Beverly Mok, Cambridge, MA (US); Joseph D. Mougous, Seattle, WA (US); Snow Brook Peterson, Seattle, WA (US); Marcos de Moraes, Seattle, WA (US); Julian Willis, Cambridge, MA (US)

(73) Assignees: The Broad Institute, Inc., Cambridge, MA (US); University of Washington, Seattle, WA (US); President and Fellows of Harvard College, Cambridge, MA (US)

( * ) Notice: Subject to any disclaimer, the term of this patent is extended or adjusted under 35 U.S.C. 154(b) by 621 days.

(21) Appl. No.: 17/795,819

(22) PCT Filed: Jan. 28, 2021

(86) PCT No.: PCT/US2021/015580

§ 371 (c)(1),
(2) Date: Jul. 27, 2022

(87) PCT Pub. No.: WO2021/155065

PCT Pub. Date: Aug. 5, 2021

(65) Prior Publication Data

US 2025/0011748 A1 Jan. 9, 2025

Related U.S. Application Data

(60) Provisional application No. 63/038,741, filed on Jun. 12, 2020, provisional application No. 62/967,027, filed on Jan. 28, 2020.

(51) Int. Cl.
*C12N 9/78* (2006.01)
*C12N 9/22* (2006.01)

(52) U.S. Cl.
CPC ................ *C12N 9/78* (2013.01); *C12N 9/22* (2013.01); *C07K 2319/07* (2013.01); (Continued)

(58) Field of Classification Search
CPC ........ C12N 9/78; C12N 9/22; C07K 2319/07; C07K 2319/09; C07K 2319/81; C07K 2319/00; C07K 2319/80; C12Y 305/04005
See application file for complete search history.

(56) References Cited

U.S. PATENT DOCUMENTS 4,182,449 A 1/1980 Kozlow
4,186,183 A 1/1980 Steck et al.
(Continued)

FOREIGN PATENT DOCUMENTS

AU 2012244264 A1 11/2012
AU 2015252023 A1 11/2015
(Continued)

OTHER PUBLICATIONS

Yang, et al. 2016. "Engineering and optimising deaminase fusions for genome editing". Nat Commun 7, 13330 (Year: 2016).*
(Continued)

*Primary Examiner* — Anand U Desai
*Assistant Examiner* — Andrew T Moehlman
(74) *Attorney, Agent, or Firm* — Wolf, Greenfield & Sacks, P.C.

(57) ABSTRACT

The specification provides programmable base editors that are capable of introducing a nucleotide change and/or which could alter or modify the nucleotide sequence at a target site in mitochondrial DNA (mtDNA) with high specificity and
(Continued)

efficiency. Moreover, the disclosure provides fusion proteins and compositions comprising a programmable DNA binding protein (e.g., a mitoTALE, a mitoZFP, or a CRISPR/Casp) and double-stranded DNA deaminase that is capable of being delivered to the mitochondria and carrying out precise installation of nucleotide changes in the mtDNA. The fusion proteins and compositions are not limited for use with mtDNA, but also may be used for base editing of any double-stranded target DNA.

18 Claims, 149 Drawing Sheets

Specification includes a Sequence Listing.

(52) U.S. Cl.
CPC ...... *C07K 2319/09* (2013.01); *C07K 2319/81* (2013.01); *C12Y 305/04005* (2013.01)

(56) References Cited

U.S. PATENT DOCUMENTS

| | | | |
|---|---|---|---|
| 4,217,344 | A | 8/1980 | Vanlerberghe et al. |
| 4,235,871 | A | 11/1980 | Papahadjopoulos et al. |
| 4,261,975 | A | 4/1981 | Fullerton et al. |
| 4,485,054 | A | 11/1984 | Mezei et al. |
| 4,501,728 | A | 2/1985 | Geho et al. |
| 4,663,290 | A | 5/1987 | Weis et al. |
| 4,737,323 | A | 4/1988 | Martin et al. |
| 4,774,085 | A | 9/1988 | Fidler |
| 4,797,368 | A | 1/1989 | Carter et al. |
| 4,837,028 | A | 6/1989 | Allen |
| 4,873,316 | A | 10/1989 | Meade et al. |
| 4,880,635 | A | 11/1989 | Janoff et al. |
| 4,889,818 | A | 12/1989 | Gelfand et al. |
| 4,897,355 | A | 1/1990 | Eppstein et al. |
| 4,906,477 | A | 3/1990 | Kurono et al. |
| 4,911,928 | A | 3/1990 | Wallach |
| 4,917,951 | A | 4/1990 | Wallach |
| 4,920,016 | A | 4/1990 | Allen et al. |
| 4,921,757 | A | 5/1990 | Wheatley et al. |
| 4,946,787 | A | 8/1990 | Eppstein et al. |
| 4,965,185 | A | 10/1990 | Grischenko et al. |
| 5,017,492 | A | 5/1991 | Kotewicz et al. |
| 5,047,342 | A | 9/1991 | Chatterjee |
| 5,049,386 | A | 9/1991 | Eppstein et al. |
| 5,079,352 | A | 1/1992 | Gelfand et al. |
| 5,139,941 | A | 8/1992 | Muzyczka et al. |
| 5,173,414 | A | 12/1992 | Lebkowski et al. |
| 5,223,409 | A | 6/1993 | Ladner et al. |
| 5,244,797 | A | 9/1993 | Kotewicz et al. |
| 5,270,179 | A | 12/1993 | Chatterjee |
| 5,374,553 | A | 12/1994 | Gelfand et al. |
| 5,405,776 | A | 4/1995 | Kotewicz et al. |
| 5,436,149 | A | 7/1995 | Barnes |
| 5,449,639 | A | 9/1995 | Wei et al. |
| 5,478,745 | A | 12/1995 | Samulski et al. |
| 5,496,714 | A | 3/1996 | Comb et al. |
| 5,512,462 | A | 4/1996 | Cheng |
| 5,580,737 | A | 12/1996 | Polisky et al. |
| 5,614,365 | A | 3/1997 | Tabor et al. |
| 5,652,094 | A | 7/1997 | Usman et al. |
| 5,658,727 | A | 8/1997 | Barbas et al. |
| 5,668,005 | A | 9/1997 | Kotewicz et al. |
| 5,677,152 | A | 10/1997 | Birch et al. |
| 5,767,099 | A | 6/1998 | Harris et al. |
| 5,780,053 | A | 7/1998 | Ashley et al. |
| 5,830,430 | A | 11/1998 | Unger et al. |
| 5,834,247 | A | 11/1998 | Comb et al. |
| 5,835,699 | A | 11/1998 | Kimura |
| 5,844,075 | A | 12/1998 | Kawakami et al. |
| 5,849,548 | A | 12/1998 | Haseloff et al. |
| 5,851,548 | A | 12/1998 | Dattagupta et al. |
| 5,855,910 | A | 1/1999 | Ashley et al. |
| 5,856,463 | A | 1/1999 | Blankenborg et al. |
| 5,962,313 | A | 10/1999 | Podsakoff et al. |
| 5,981,182 | A | 11/1999 | Jacobs, Jr. et al. |
| 6,015,794 | A | 1/2000 | Haseloff et al. |
| 6,057,153 | A | 5/2000 | George et al. |
| 6,063,608 | A | 5/2000 | Kotewicz et al. |
| 6,077,705 | A | 6/2000 | Duan et al. |
| 6,099,857 | A | 8/2000 | Gross |
| 6,140,081 | A | 10/2000 | Barbas |
| 6,156,509 | A | 12/2000 | Schellenberger |
| 6,183,998 | B1 | 2/2001 | Ivanov et al. |
| 6,355,415 | B1 | 3/2002 | Wagner et al. |
| 6,416,997 | B1 | 7/2002 | Mir-Shekari et al. |
| 6,429,298 | B1 | 8/2002 | Ellington et al. |
| 6,453,242 | B1 | 9/2002 | Eisenberg et al. |
| 6,479,264 | B1 | 11/2002 | Louwrier |
| 6,503,717 | B2 | 1/2003 | Case et al. |
| 6,534,261 | B1 | 3/2003 | Cox, III et al. |
| 6,558,671 | B1 | 5/2003 | Slingluff et al. |
| 6,589,768 | B1 | 7/2003 | Kotewicz et al. |
| 6,599,692 | B1 | 7/2003 | Case et al. |
| 6,607,882 | B1 | 8/2003 | Cox, III et al. |
| 6,610,522 | B1 | 8/2003 | Kotewicz et al. |
| 6,689,558 | B2 | 2/2004 | Case et al. |
| 6,716,973 | B2 | 4/2004 | Baskerville et al. |
| 6,746,838 | B1 | 6/2004 | Choo et al. |
| 6,785,613 | B2 | 8/2004 | Eisenberg et al. |
| 6,815,194 | B2 | 11/2004 | Honjo et al. |
| 6,824,978 | B1 | 11/2004 | Cox, III et al. |
| 6,866,997 | B1 | 3/2005 | Choo et al. |
| 6,933,113 | B2 | 8/2005 | Case et al. |
| 6,979,539 | B2 | 12/2005 | Cox, III et al. |
| 7,013,219 | B2 | 3/2006 | Case et al. |
| 7,030,215 | B2 | 4/2006 | Liu et al. |
| 7,045,337 | B2 | 5/2006 | Schultz et al. |
| 7,067,650 | B1 | 6/2006 | Tanaka |
| 7,070,928 | B2 | 7/2006 | Liu et al. |
| 7,078,208 | B2 | 7/2006 | Smith et al. |
| 7,083,970 | B2 | 8/2006 | Schultz et al. |
| 7,163,824 | B2 | 1/2007 | Cox, III et al. |
| 7,192,739 | B2 | 3/2007 | Liu et al. |
| 7,223,545 | B2 | 5/2007 | Liu et al. |
| 7,329,807 | B2 | 2/2008 | Vadrucci et al. |
| 7,354,761 | B2 | 4/2008 | Schultz et al. |
| 7,368,275 | B2 | 5/2008 | Schultz et al. |
| 7,419,669 | B2 | 9/2008 | Kosmatopoulos et al. |
| 7,442,160 | B2 | 10/2008 | Liu et al. |
| 7,476,500 | B1 | 1/2009 | Liu et al. |
| 7,476,734 | B2 | 1/2009 | Liu |
| 7,479,573 | B2 | 1/2009 | Chu et al. |
| 7,488,718 | B2 | 2/2009 | Scheinberg et al. |
| 7,491,494 | B2 | 2/2009 | Liu et al. |
| 7,510,706 | B2 | 3/2009 | Yonemitsu et al. |
| 7,541,450 | B2 | 6/2009 | Liu et al. |
| 7,556,940 | B2 | 7/2009 | Galarza et al. |
| 7,557,068 | B2 | 7/2009 | Liu et al. |
| 7,595,179 | B2 | 9/2009 | Chen et al. |
| 7,638,300 | B2 | 12/2009 | Schultz et al. |
| 7,670,807 | B2 | 3/2010 | Lampson et al. |
| 7,678,554 | B2 | 3/2010 | Liu et al. |
| 7,713,721 | B2 | 5/2010 | Schultz et al. |
| 7,771,935 | B2 | 8/2010 | Liu et al. |
| 7,794,931 | B2 | 9/2010 | Breaker et al. |
| 7,807,408 | B2 | 10/2010 | Liu et al. |
| 7,851,658 | B2 | 12/2010 | Liu et al. |
| 7,915,025 | B2 | 3/2011 | Schultz et al. |
| 7,919,277 | B2 | 4/2011 | Russell et al. |
| 7,993,672 | B2 | 8/2011 | Huang et al. |
| 7,998,904 | B2 | 8/2011 | Liu et al. |
| 7,999,071 | B2 | 8/2011 | Schlom et al. |
| 8,012,739 | B2 | 9/2011 | Schultz et al. |
| 8,017,323 | B2 | 9/2011 | Liu et al. |
| 8,017,755 | B2 | 9/2011 | Liu et al. |
| 8,030,074 | B2 | 10/2011 | Schultz et al. |
| 8,067,556 | B2 | 11/2011 | Hogrefe et al. |
| 8,114,648 | B2 | 2/2012 | Schultz et al. |
| 8,173,364 | B2 | 5/2012 | Schultz et al. |
| 8,173,392 | B2 | 5/2012 | Schultz et al. |

(56) References Cited

U.S. PATENT DOCUMENTS

| | | | |
|---|---|---|---|
| 8,183,012 | B2 | 5/2012 | Schultz et al. |
| 8,183,178 | B2 | 5/2012 | Liu et al. |
| 8,206,914 | B2 | 6/2012 | Liu et al. |
| 8,354,380 | B2 | 1/2013 | Liu et al. |
| 8,361,725 | B2 | 1/2013 | Russell et al. |
| 8,394,604 | B2 | 3/2013 | Liu et al. |
| 8,420,104 | B2 | 4/2013 | Charneau et al. |
| 8,440,431 | B2 | 5/2013 | Voytas et al. |
| 8,440,432 | B2 | 5/2013 | Voytas et al. |
| 8,450,471 | B2 | 5/2013 | Voytas et al. |
| 8,492,082 | B2 | 7/2013 | De Franciscis et al. |
| 8,546,553 | B2 | 10/2013 | Terns et al. |
| 8,569,256 | B2 | 10/2013 | Heyes et al. |
| 8,586,363 | B2 | 11/2013 | Voytas et al. |
| 8,673,612 | B2 | 3/2014 | Klatzmann et al. |
| 8,680,069 | B2 | 3/2014 | de Fougerolles et al. |
| 8,691,729 | B2 | 4/2014 | Liu et al. |
| 8,691,750 | B2 | 4/2014 | Constien et al. |
| 8,697,359 | B1 | 4/2014 | Zhang |
| 8,697,439 | B2 | 4/2014 | Mangeot et al. |
| 8,697,853 | B2 | 4/2014 | Voytas et al. |
| 8,709,466 | B2 | 4/2014 | Coady et al. |
| 8,728,526 | B2 | 5/2014 | Heller |
| 8,729,038 | B2 | 5/2014 | Gruber et al. |
| 8,741,279 | B2 | 6/2014 | Kasahara et al. |
| 8,748,667 | B2 | 6/2014 | Budzik et al. |
| 8,758,810 | B2 | 6/2014 | Okada et al. |
| 8,759,103 | B2 | 6/2014 | Kim et al. |
| 8,759,104 | B2 | 6/2014 | Unciti-Broceta et al. |
| 8,771,728 | B2 | 7/2014 | Huang et al. |
| 8,790,664 | B2 | 7/2014 | Pitard et al. |
| 8,795,965 | B2 | 8/2014 | Zhang |
| 8,822,663 | B2 | 9/2014 | Schrum et al. |
| 8,835,148 | B2 | 9/2014 | Janulaitis et al. |
| 8,846,578 | B2 | 9/2014 | McCray et al. |
| 8,871,445 | B2 | 10/2014 | Cong et al. |
| 8,889,418 | B2 | 11/2014 | Zhang et al. |
| 8,900,814 | B2 | 12/2014 | Yasukawa et al. |
| 8,945,839 | B2 | 2/2015 | Zhang |
| 8,975,232 | B2 | 3/2015 | Liu et al. |
| 8,993,233 | B2 | 3/2015 | Zhang et al. |
| 8,999,641 | B2 | 4/2015 | Zhang et al. |
| 9,023,594 | B2 | 5/2015 | Liu et al. |
| 9,023,649 | B2 | 5/2015 | Mali et al. |
| 9,034,650 | B2 | 5/2015 | Padidam |
| 9,068,179 | B1 | 6/2015 | Liu et al. |
| 9,150,626 | B2 | 10/2015 | Liu et al. |
| 9,163,271 | B2 | 10/2015 | Schultz et al. |
| 9,163,284 | B2 | 10/2015 | Liu et al. |
| 9,181,535 | B2 | 11/2015 | Liu et al. |
| 9,200,045 | B2 | 12/2015 | Liu et al. |
| 9,221,886 | B2 | 12/2015 | Liu et al. |
| 9,228,207 | B2 | 1/2016 | Liu et al. |
| 9,234,213 | B2 | 1/2016 | Wu |
| 9,243,038 | B2 | 1/2016 | Liu et al. |
| 9,267,127 | B2 | 2/2016 | Liu et al. |
| 9,290,773 | B2 | 3/2016 | Edgerton |
| 9,296,790 | B2 | 3/2016 | Chatterjee et al. |
| 9,322,006 | B2 | 4/2016 | Liu et al. |
| 9,322,037 | B2 | 4/2016 | Liu et al. |
| 9,340,799 | B2 | 5/2016 | Liu et al. |
| 9,340,800 | B2 | 5/2016 | Liu et al. |
| 9,359,599 | B2 | 6/2016 | Liu et al. |
| 9,388,430 | B2 | 7/2016 | Liu et al. |
| 9,394,537 | B2 | 7/2016 | Liu et al. |
| 9,434,774 | B2 | 9/2016 | Liu et al. |
| 9,458,484 | B2 | 10/2016 | Ma et al. |
| 9,512,446 | B1 | 12/2016 | Joung et al. |
| 9,526,784 | B2 | 12/2016 | Liu et al. |
| 9,534,210 | B2 | 1/2017 | Park et al. |
| 9,580,698 | B1 | 2/2017 | Xu et al. |
| 9,593,356 | B2 | 3/2017 | Haugwitz et al. |
| 9,610,322 | B2 | 4/2017 | Liu et al. |
| 9,637,739 | B2 | 5/2017 | Siksnys et al. |
| 9,663,770 | B2 | 5/2017 | Rogers et al. |
| 9,663,782 | B2 | 5/2017 | Yu et al. |
| 9,695,446 | B2 | 7/2017 | Mangeot et al. |
| 9,737,604 | B2 | 8/2017 | Jin et al. |
| 9,738,693 | B2 | 8/2017 | Telford et al. |
| 9,753,340 | B2 | 9/2017 | Saitou |
| 9,765,304 | B2 | 9/2017 | Klatzmann et al. |
| 9,771,574 | B2 | 9/2017 | Liu et al. |
| 9,777,043 | B2 | 10/2017 | Anderson et al. |
| 9,783,791 | B2 | 10/2017 | Hogrefe et al. |
| 9,816,093 | B1 | 11/2017 | Donohoue et al. |
| 9,840,538 | B2 | 12/2017 | Telford et al. |
| 9,840,690 | B2 | 12/2017 | Karli et al. |
| 9,840,699 | B2 | 12/2017 | Liu et al. |
| 9,840,702 | B2 | 12/2017 | Collingwood et al. |
| 9,850,521 | B2 | 12/2017 | Braman et al. |
| 9,873,907 | B2 | 1/2018 | Zeiner et al. |
| 9,879,270 | B2 | 1/2018 | Hittinger et al. |
| 9,914,939 | B2 | 3/2018 | Church et al. |
| 9,932,567 | B1 | 4/2018 | Xu et al. |
| 9,938,288 | B1 | 4/2018 | Kishi et al. |
| 9,944,933 | B2 | 4/2018 | Storici et al. |
| 9,982,279 | B1 | 5/2018 | Gill et al. |
| 9,999,671 | B2 | 6/2018 | Liu et al. |
| 10,011,868 | B2 | 7/2018 | Liu et al. |
| 10,040,830 | B2 | 8/2018 | Chatterjee et al. |
| 10,053,725 | B2 | 8/2018 | Liu et al. |
| 10,059,940 | B2 | 8/2018 | Zhong |
| 10,077,453 | B2 | 9/2018 | Liu et al. |
| 10,113,163 | B2 | 10/2018 | Liu et al. |
| 10,150,955 | B2 | 12/2018 | Lambowitz et al. |
| 10,167,457 | B2 | 1/2019 | Liu et al. |
| 10,179,911 | B2 | 1/2019 | Liu et al. |
| 10,189,831 | B2 | 1/2019 | Arrington et al. |
| 10,202,593 | B2 | 2/2019 | Liu et al. |
| 10,202,658 | B2 | 2/2019 | Parkin et al. |
| 10,227,581 | B2 | 3/2019 | Liu et al. |
| 10,323,236 | B2 | 6/2019 | Liu et al. |
| 10,336,997 | B2 | 7/2019 | Liu et al. |
| 10,358,670 | B2 | 7/2019 | Janulaitis et al. |
| 10,392,674 | B2 | 8/2019 | Liu et al. |
| 10,407,474 | B2 | 9/2019 | Liu et al. |
| 10,407,695 | B2 | 9/2019 | Charneau et al. |
| 10,407,697 | B2 | 9/2019 | Doudna et al. |
| 10,465,176 | B2 | 11/2019 | Liu et al. |
| 10,508,298 | B2 | 12/2019 | Liu et al. |
| 10,583,201 | B2 | 3/2020 | Chen et al. |
| 10,597,679 | B2 | 3/2020 | Liu et al. |
| 10,612,011 | B2 | 4/2020 | Liu et al. |
| 10,640,767 | B2 | 5/2020 | Maianti et al. |
| 10,682,410 | B2 | 6/2020 | Liu et al. |
| 10,704,062 | B2 | 7/2020 | Liu et al. |
| 10,745,677 | B2 | 8/2020 | Maianti et al. |
| 10,858,639 | B2 | 12/2020 | Liu et al. |
| 10,912,833 | B2 | 2/2021 | Liu et al. |
| 10,930,367 | B2 | 2/2021 | Zhang et al. |
| 10,947,530 | B2 | 3/2021 | Liu et al. |
| 10,954,548 | B2 | 3/2021 | Liu et al. |
| 10,968,253 | B2 | 4/2021 | Ohlmann et al. |
| 11,046,948 | B2 | 6/2021 | Liu et al. |
| 11,053,481 | B2 | 7/2021 | Liu et al. |
| 11,124,782 | B2 | 9/2021 | Liu et al. |
| 11,142,760 | B2 | 10/2021 | Slaymaker et al. |
| 11,214,780 | B2 | 1/2022 | Liu et al. |
| 11,268,082 | B2 | 3/2022 | Liu et al. |
| 11,299,755 | B2 | 4/2022 | Liu et al. |
| 11,306,324 | B2 | 4/2022 | Liu et al. |
| 11,319,532 | B2 | 5/2022 | Liu et al. |
| 11,421,016 | B2 | 8/2022 | Nguyen |
| 11,447,527 | B2 | 9/2022 | Malone et al. |
| 11,447,770 | B1 | 9/2022 | Liu et al. |
| 11,505,578 | B2 | 11/2022 | Malone et al. |
| 11,542,496 | B2 | 1/2023 | Liu et al. |
| 11,542,509 | B2 | 1/2023 | Maianti et al. |
| 11,560,566 | B2 | 1/2023 | Tang et al. |
| 11,578,343 | B2 | 2/2023 | Liu et al. |
| 11,643,652 | B2 | 5/2023 | Liu et al. |
| 11,661,590 | B2 | 5/2023 | Liu et al. |
| 11,702,651 | B2 | 7/2023 | Liu et al. |
| 11,732,274 | B2 | 8/2023 | Liu et al. |

(56) References Cited

U.S. PATENT DOCUMENTS 11,795,443 B2 10/2023 Liu et al.
11,795,452 B2 10/2023 Liu et al.
11,820,969 B2 11/2023 Maianti et al.
11,898,179 B2 2/2024 Maianti et al.
11,912,985 B2 2/2024 Liu et al.
11,920,181 B2 3/2024 Liu et al.
11,932,884 B2 3/2024 Liu et al.
11,999,947 B2 6/2024 Liu et al.
12,006,520 B2 6/2024 Liu et al.
12,031,126 B2 7/2024 Liu et al.
12,043,852 B2 7/2024 Liu et al.
12,084,663 B2 9/2024 Maianti et al.
12,157,760 B2 12/2024 Liu et al.
12,215,365 B2 2/2025 Liu et al.
12,281,303 B2 4/2025 Liu et al.
12,281,338 B2 4/2025 Liu et al.
12,344,869 B2 7/2025 Liu et al.
12,351,837 B2 7/2025 Kim et al.
12,359,218 B2 7/2025 Liu et al.
12,390,514 B2 8/2025 Maianti et al.
12,398,406 B2 8/2025 Liu et al.
12,406,749 B2 9/2025 Shen et al.
12,435,331 B2 10/2025 Liu et al.
12,473,543 B2 11/2025 Liu et al.
2003/0082575 A1 5/2003 Schultz et al.
2003/0087817 A1 5/2003 Cox et al.
2003/0096337 A1 5/2003 Hillman et al.
2003/0103939 A1 6/2003 Engelhardt et al.
2003/0108885 A1 6/2003 Schultz et al.
2003/0119764 A1 6/2003 Loeb et al.
2003/0167533 A1 9/2003 Yadav et al.
2003/0203480 A1 10/2003 Kovesdi et al.
2004/0003420 A1 1/2004 Kuhn et al.
2004/0028687 A1 2/2004 Waelti
2004/0115184 A1 6/2004 Smith et al.
2004/0156861 A1 8/2004 Figdor et al.
2004/0197892 A1 10/2004 Moore et al.
2004/0203109 A1 10/2004 Lal et al.
2005/0100890 A1 5/2005 Davidson et al.
2005/0136429 A1 6/2005 Guarente et al.
2005/0222030 A1 10/2005 Allison
2005/0260626 A1 11/2005 Lorens et al.
2006/0088864 A1 4/2006 Smolke et al.
2006/0104984 A1 5/2006 Littlefield et al.
2006/0216702 A1 9/2006 Compans et al.
2006/0246568 A1 11/2006 Honjo et al.
2007/0015238 A1 1/2007 Snyder et al.
2007/0049533 A1 3/2007 Liu et al.
2007/0264692 A1 11/2007 Liu et al.
2007/0269817 A1 11/2007 Shapero
2007/0298118 A1 12/2007 Lotvall et al.
2008/0008697 A1 1/2008 Mintier et al.
2008/0051317 A1 2/2008 Church et al.
2008/0124725 A1 5/2008 Barrangou et al.
2008/0182254 A1 7/2008 Hall et al.
2008/0220502 A1 9/2008 Schellenberger et al.
2008/0241917 A1 10/2008 Akita et al.
2008/0268516 A1 10/2008 Perreault et al.
2009/0111119 A1 4/2009 Doyon et al.
2009/0130718 A1 5/2009 Short
2009/0202622 A1 8/2009 Fleury et al.
2009/0215878 A1 8/2009 Tan et al.
2009/0234109 A1 9/2009 Han et al.
2010/0076057 A1 3/2010 Sontheimer et al.
2010/0093617 A1 4/2010 Barrangou et al.
2010/0104690 A1 4/2010 Barrangou et al.
2010/0105134 A1 4/2010 Quay et al.
2010/0273857 A1 10/2010 Thakker et al.
2010/0305197 A1 12/2010 Che
2010/0316643 A1 12/2010 Eckert et al.
2011/0016540 A1 1/2011 Weinstein et al.
2011/0059160 A1 3/2011 Essner et al.
2011/0059502 A1 3/2011 Chalasani
2011/0077199 A1 3/2011 Schellenberger et al.
2011/0104787 A1 5/2011 Church et al.
2011/0123509 A1 5/2011 Jantz et al.
2011/0177495 A1 7/2011 Liu et al.
2011/0189775 A1 8/2011 Ainley et al.
2011/0189776 A1 8/2011 Terns et al.
2011/0206672 A1 8/2011 Little
2011/0217739 A1 9/2011 Terns et al.
2011/0301073 A1 12/2011 Gregory et al.
2012/0129759 A1 5/2012 Liu et al.
2012/0141523 A1 6/2012 Castado et al.
2012/0159653 A1 6/2012 Weinstein et al.
2012/0244601 A1 9/2012 Bertozzi et al.
2012/0270273 A1 10/2012 Zhang et al.
2012/0322861 A1 12/2012 Byrne et al.
2013/0022980 A1 1/2013 Nelson et al.
2013/0053426 A1 2/2013 Seow et al.
2013/0059931 A1 3/2013 Petersen-Mahrt et al.
2013/0108657 A1 5/2013 Yee et al.
2013/0117869 A1 5/2013 Duchateau et al.
2013/0130248 A1 5/2013 Haurwitz et al.
2013/0158245 A1 6/2013 Russell et al.
2013/0165389 A1 6/2013 Schellenberger et al.
2013/0212725 A1 8/2013 Kuhn et al.
2013/0309720 A1 11/2013 Schultz et al.
2013/0344117 A1 12/2013 Mirosevich et al.
2013/0345064 A1 12/2013 Liu et al.
2014/0004280 A1 1/2014 Loomis
2014/0005269 A1 1/2014 Ngwuluka et al.
2014/0017214 A1 1/2014 Cost
2014/0018404 A1 1/2014 Chen et al.
2014/0044793 A1 2/2014 Goll et al.
2014/0065711 A1 3/2014 Liu et al.
2014/0068797 A1 3/2014 Doudna et al.
2014/0127752 A1 5/2014 Zhou et al.
2014/0128449 A1 5/2014 Liu et al.
2014/0141094 A1 5/2014 Smyth et al.
2014/0141487 A1 5/2014 Feldman et al.
2014/0179770 A1 6/2014 Zhang et al.
2014/0186843 A1 7/2014 Zhang et al.
2014/0186919 A1 7/2014 Zhang et al.
2014/0186958 A1 7/2014 Zhang et al.
2014/0201858 A1 7/2014 Ostertag et al.
2014/0234289 A1 8/2014 Liu et al.
2014/0248702 A1 9/2014 Zhang et al.
2014/0256046 A1 9/2014 Zhang et al.
2014/0273037 A1 9/2014 Wu
2014/0273226 A1 9/2014 Wu
2014/0273230 A1 9/2014 Chen et al.
2014/0273234 A1 9/2014 Zhang et al.
2014/0283156 A1 9/2014 Zador et al.
2014/0295556 A1 10/2014 Joung et al.
2014/0295557 A1 10/2014 Joung et al.
2014/0342456 A1 11/2014 Mali et al.
2014/0342457 A1 11/2014 Mali et al.
2014/0342458 A1 11/2014 Mali et al.
2014/0349400 A1 11/2014 Jakimo et al.
2014/0356867 A1 12/2014 Peter et al.
2014/0356956 A1 12/2014 Church et al.
2014/0356958 A1 12/2014 Mali et al.
2014/0356959 A1 12/2014 Church et al.
2014/0357523 A1 12/2014 Zeiner et al.
2014/0377868 A1 12/2014 Joung et al.
2015/0010526 A1 1/2015 Liu et al.
2015/0031089 A1 1/2015 Lindstrom
2015/0031132 A1 1/2015 Church et al.
2015/0031133 A1 1/2015 Church et al.
2015/0044191 A1 2/2015 Liu et al.
2015/0044192 A1 2/2015 Liu et al.
2015/0044772 A1 2/2015 Zhao
2015/0050699 A1 2/2015 Siksnys et al.
2015/0056177 A1 2/2015 Liu et al.
2015/0056629 A1 2/2015 Guthrie-Honea
2015/0064138 A1 3/2015 Lu et al.
2015/0064789 A1 3/2015 Paschon et al.
2015/0071898 A1 3/2015 Liu et al.
2015/0071899 A1 3/2015 Liu et al.
2015/0071900 A1 3/2015 Liu et al.
2015/0071901 A1 3/2015 Liu et al.
2015/0071902 A1 3/2015 Liu et al.
2015/0071903 A1 3/2015 Liu et al.

(56) References Cited

U.S. PATENT DOCUMENTS

2015/0071906 A1 3/2015 Liu et al.
2015/0079680 A1 3/2015 Bradley et al.
2015/0079681 A1 3/2015 Zhang
2015/0098954 A1 4/2015 Hyde et al.
2015/0118216 A1 4/2015 Liu et al.
2015/0128300 A1 5/2015 Warming et al.
2015/0132269 A1 5/2015 Orkin et al.
2015/0140664 A1 5/2015 Byrne et al.
2015/0159172 A1 6/2015 Miller et al.
2015/0165054 A1 6/2015 Liu et al.
2015/0166980 A1 6/2015 Liu et al.
2015/0166981 A1 6/2015 Liu et al.
2015/0166982 A1 6/2015 Liu et al.
2015/0166983 A1 6/2015 Liu et al.
2015/0166984 A1 6/2015 Liu et al.
2015/0166985 A1 6/2015 Liu et al.
2015/0191744 A1 7/2015 Wolfe et al.
2015/0197759 A1 7/2015 Xu et al.
2015/0211058 A1 7/2015 Carstens
2015/0218573 A1 8/2015 Loque et al.
2015/0225773 A1 8/2015 Farmer et al.
2015/0241440 A1 8/2015 Fasan et al.
2015/0252358 A1 9/2015 Maeder et al.
2015/0275202 A1 10/2015 Liu et al.
2015/0291965 A1 10/2015 Zhang et al.
2015/0307889 A1 10/2015 Petolino et al.
2015/0315252 A1 11/2015 Haugwitz et al.
2015/0344549 A1 12/2015 Muir et al.
2016/0017393 A1 1/2016 Jacobson et al.
2016/0017396 A1 1/2016 Cann et al.
2016/0032292 A1 2/2016 Storici et al.
2016/0032353 A1 2/2016 Braman et al.
2016/0040155 A1 2/2016 Maizels et al.
2016/0046952 A1 2/2016 Hittinger et al.
2016/0046961 A1 2/2016 Jinek et al.
2016/0046962 A1 2/2016 May et al.
2016/0053272 A1 2/2016 Wurtzel et al.
2016/0053304 A1 2/2016 Wurtzel et al.
2016/0074535 A1 3/2016 Ranganathan et al.
2016/0076093 A1 3/2016 Shendure et al.
2016/0090603 A1 3/2016 Carnes et al.
2016/0090622 A1 3/2016 Liu et al.
2016/0115488 A1 4/2016 Zhang et al.
2016/0137716 A1 5/2016 El Andaloussi et al.
2016/0138046 A1 5/2016 Wu
2016/0153003 A1 6/2016 Joung et al.
2016/0186214 A1 6/2016 Brouns et al.
2016/0200779 A1 7/2016 Liu et al.
2016/0201040 A1 7/2016 Liu et al.
2016/0201089 A1 7/2016 Gersbach et al.
2016/0206566 A1 7/2016 Lu et al.
2016/0208243 A1 7/2016 Zhang et al.
2016/0208288 A1 7/2016 Liu et al.
2016/0215275 A1 7/2016 Zhong
2016/0215276 A1 7/2016 Liu et al.
2016/0215300 A1 7/2016 May et al.
2016/0244784 A1 8/2016 Jacobson et al.
2016/0244829 A1 8/2016 Bang et al.
2016/0264934 A1 9/2016 Giallourakis et al.
2016/0272593 A1 9/2016 Ritter et al.
2016/0272965 A1 9/2016 Zhang et al.
2016/0281072 A1 9/2016 Zhang
2016/0298136 A1 10/2016 Chen et al.
2016/0304846 A1 10/2016 Liu et al.
2016/0304855 A1 10/2016 Stark et al.
2016/0312304 A1 10/2016 Sorrentino et al.
2016/0319262 A1 11/2016 Doudna et al.
2016/0333389 A1 11/2016 Liu et al.
2016/0340622 A1 11/2016 Abdou
2016/0340661 A1 11/2016 Cong et al.
2016/0340662 A1 11/2016 Zhang et al.
2016/0345578 A1 12/2016 Barrangou et al.
2016/0346360 A1 12/2016 Quake et al.
2016/0346361 A1 12/2016 Quake et al.
2016/0346362 A1 12/2016 Quake et al.
2016/0348074 A1 12/2016 Quake et al.
2016/0348096 A1 12/2016 Liu et al.
2016/0350476 A1 12/2016 Quake et al.
2016/0355796 A1 12/2016 Davidson et al.
2016/0369262 A1 12/2016 Reik et al.
2017/0009224 A1 1/2017 Liu et al.
2017/0009242 A1 1/2017 McKinley et al.
2017/0014449 A1 1/2017 Bangera et al.
2017/0020922 A1 1/2017 Wagner et al.
2017/0022251 A1 1/2017 Rammensee et al.
2017/0037432 A1 2/2017 Donohoue et al.
2017/0044520 A1 2/2017 Liu et al.
2017/0044592 A1 2/2017 Peter et al.
2017/0053729 A1 2/2017 Kotani et al.
2017/0058271 A1 3/2017 Joung et al.
2017/0058272 A1 3/2017 Carter et al.
2017/0058298 A1 3/2017 Kennedy et al.
2017/0073663 A1 3/2017 Wang et al.
2017/0073670 A1 3/2017 Nishida et al.
2017/0087224 A1 3/2017 Quake
2017/0087225 A1 3/2017 Quake
2017/0088587 A1 3/2017 Quake
2017/0088828 A1 3/2017 Quake
2017/0107536 A1 4/2017 Zhang et al.
2017/0107560 A1 4/2017 Peter et al.
2017/0112773 A1 4/2017 Stachowiak et al.
2017/0114367 A1 4/2017 Hu et al.
2017/0121693 A1 5/2017 Liu et al.
2017/0145394 A1 5/2017 Yeo et al.
2017/0145405 A1 5/2017 Tang et al.
2017/0145438 A1 5/2017 Kantor
2017/0152528 A1 6/2017 Zhang
2017/0152787 A1 6/2017 Kubo et al.
2017/0159033 A1 6/2017 Kamtekar et al.
2017/0166928 A1 6/2017 Vyas et al.
2017/0173113 A1 6/2017 Besner et al.
2017/0175086 A1 6/2017 Schmitt et al.
2017/0175104 A1 6/2017 Doudna et al.
2017/0175142 A1 6/2017 Zhang et al.
2017/0191047 A1 7/2017 Terns et al.
2017/0191078 A1 7/2017 Zhang et al.
2017/0198269 A1 7/2017 Zhang et al.
2017/0198277 A1 7/2017 Kmiec et al.
2017/0198302 A1 7/2017 Feng et al.
2017/0211061 A1 7/2017 Weiss et al.
2017/0224843 A1 8/2017 Deglon et al.
2017/0226522 A1 8/2017 Hu et al.
2017/0233703 A1 8/2017 Xie et al.
2017/0233708 A1 8/2017 Liu et al.
2017/0233756 A1 8/2017 Begemann et al.
2017/0247671 A1 8/2017 Yung et al.
2017/0247703 A1 8/2017 Sloan et al.
2017/0268022 A1 9/2017 Liu et al.
2017/0275648 A1 9/2017 Barrangou et al.
2017/0275665 A1 9/2017 Silas et al.
2017/0283797 A1 10/2017 Robb et al.
2017/0283831 A1 10/2017 Zhang et al.
2017/0306306 A1 10/2017 Potter et al.
2017/0314016 A1 11/2017 Kim et al.
2017/0362635 A1 12/2017 Chamberlain et al.
2018/0023062 A1 1/2018 Lamb et al.
2018/0037877 A1 2/2018 Gao et al.
2018/0064077 A1 3/2018 Dunham et al.
2018/0066258 A1 3/2018 Powell
2018/0068062 A1 3/2018 Zhang et al.
2018/0073012 A1 3/2018 Liu et al.
2018/0080051 A1 3/2018 Sheikh et al.
2018/0087046 A1 3/2018 Badran et al.
2018/0100147 A1 4/2018 Yates et al.
2018/0105867 A1 4/2018 Xiao et al.
2018/0119118 A1 5/2018 Lu et al.
2018/0127759 A1 5/2018 Lu et al.
2018/0127780 A1 5/2018 Liu et al.
2018/0155708 A1 6/2018 Church et al.
2018/0155720 A1 6/2018 Donohoue et al.
2018/0163213 A1 6/2018 Aneja et al.
2018/0170984 A1 6/2018 Harris et al.
2018/0177727 A1 6/2018 Kalluri et al.
2018/0179503 A1 6/2018 Maianti et al.

(56) References Cited

U.S. PATENT DOCUMENTS

| | | | |
|---|---|---|---|
| 2018/0179547 | A1 | 6/2018 | Zhang et al. |
| 2018/0201921 | A1 | 7/2018 | Malcolm |
| 2018/0230464 | A1 | 8/2018 | Zhong |
| 2018/0230471 | A1 | 8/2018 | Storici et al. |
| 2018/0236081 | A1 | 8/2018 | Liu et al. |
| 2018/0237787 | A1 | 8/2018 | Maianti et al. |
| 2018/0245066 | A1 | 8/2018 | Yao et al. |
| 2018/0245075 | A1 | 8/2018 | Khalil et al. |
| 2018/0258418 | A1 | 9/2018 | Kim |
| 2018/0265864 | A1 | 9/2018 | Li et al. |
| 2018/0273935 | A1 | 9/2018 | Lane et al. |
| 2018/0273939 | A1 | 9/2018 | Yu et al. |
| 2018/0273976 | A1 | 9/2018 | Ümit et al. |
| 2018/0282722 | A1 | 10/2018 | Jakimo et al. |
| 2018/0298391 | A1 | 10/2018 | Jakimo et al. |
| 2018/0305688 | A1 | 10/2018 | Zhong |
| 2018/0305704 | A1 | 10/2018 | Zhang |
| 2018/0312822 | A1 | 11/2018 | Lee et al. |
| 2018/0312825 | A1 | 11/2018 | Liu et al. |
| 2018/0312828 | A1 | 11/2018 | Liu et al. |
| 2018/0312835 | A1 | 11/2018 | Yao et al. |
| 2018/0327756 | A1 | 11/2018 | Zhang et al. |
| 2018/0346927 | A1 | 12/2018 | Doudna et al. |
| 2018/0371497 | A1 | 12/2018 | Gill et al. |
| 2019/0010481 | A1 | 1/2019 | Joung et al. |
| 2019/0032053 | A1 | 1/2019 | Ji et al. |
| 2019/0055543 | A1 | 2/2019 | Tran et al. |
| 2019/0055549 | A1 | 2/2019 | Capurso et al. |
| 2019/0062734 | A1 | 2/2019 | Cotta-Ramusino et al. |
| 2019/0093099 | A1 | 3/2019 | Liu et al. |
| 2019/0119701 | A1 | 4/2019 | Liang et al. |
| 2019/0135869 | A1 | 5/2019 | Chatterjee et al. |
| 2019/0167810 | A1 | 6/2019 | Hean et al. |
| 2019/0185883 | A1 | 6/2019 | Liu et al. |
| 2019/0203228 | A1 | 7/2019 | Bouille et al. |
| 2019/0218547 | A1 | 7/2019 | Lee et al. |
| 2019/0224331 | A1 | 7/2019 | Wiklander |
| 2019/0225955 | A1 | 7/2019 | Liu et al. |
| 2019/0233814 | A1 | 8/2019 | Zhang et al. |
| 2019/0233847 | A1 | 8/2019 | Savage et al. |
| 2019/0241633 | A1 | 8/2019 | Fotin-Mleczek et al. |
| 2019/0256842 | A1 | 8/2019 | Liu et al. |
| 2019/0264202 | A1 | 8/2019 | Church et al. |
| 2019/0276816 | A1 | 9/2019 | Liu et al. |
| 2019/0309290 | A1 | 10/2019 | Neuteboom et al. |
| 2019/0322992 | A1 | 10/2019 | Liu et al. |
| 2019/0330619 | A1 | 10/2019 | Smith et al. |
| 2019/0352632 | A1 | 11/2019 | Liu et al. |
| 2019/0367891 | A1 | 12/2019 | Liu et al. |
| 2019/0388347 | A1 | 12/2019 | Wiklander et al. |
| 2020/0010818 | A1 | 1/2020 | Liu et al. |
| 2020/0010835 | A1 | 1/2020 | Maianti et al. |
| 2020/0023012 | A1 | 1/2020 | Joseph et al. |
| 2020/0056206 | A1 | 2/2020 | Tremblay et al. |
| 2020/0060980 | A1 | 2/2020 | Von Maltzahn et al. |
| 2020/0062813 | A1 | 2/2020 | Nordin et al. |
| 2020/0063127 | A1 | 2/2020 | Lu et al. |
| 2020/0071722 | A1 | 3/2020 | Liu et al. |
| 2020/0109398 | A1 | 4/2020 | Rubens et al. |
| 2020/0157570 | A1 | 5/2020 | Loiler |
| 2020/0172931 | A1 | 6/2020 | Liu et al. |
| 2020/0181619 | A1 | 6/2020 | Tang et al. |
| 2020/0190493 | A1 | 6/2020 | Liu et al. |
| 2020/0206360 | A1 | 7/2020 | Choi et al. |
| 2020/0216833 | A1 | 7/2020 | Liu et al. |
| 2020/0248156 | A1 | 8/2020 | Joung et al. |
| 2020/0255868 | A1 | 8/2020 | Liu et al. |
| 2020/0277587 | A1 | 9/2020 | Liu et al. |
| 2020/0291072 | A1 | 9/2020 | Wang et al. |
| 2020/0308571 | A1 | 10/2020 | Joung et al. |
| 2020/0318116 | A1 | 10/2020 | Freier |
| 2020/0323984 | A1 | 10/2020 | Liu et al. |
| 2020/0347100 | A1 | 11/2020 | Zhang |
| 2020/0399619 | A1 | 12/2020 | Maianti et al. |
| 2020/0399626 | A1 | 12/2020 | Liu et al. |
| 2020/0405639 | A1 | 12/2020 | Zhang et al. |
| 2020/0407418 | A1 | 12/2020 | Nordin et al. |
| 2021/0054416 | A1 | 2/2021 | Liu et al. |
| 2021/0069254 | A1 | 3/2021 | Görgens et al. |
| 2021/0115428 | A1 | 4/2021 | Maianti et al. |
| 2021/0137839 | A1 | 5/2021 | Von Maltzahn et al. |
| 2021/0187018 | A1 | 6/2021 | Von Maltzahn et al. |
| 2021/0188903 | A1 | 6/2021 | Wiklander et al. |
| 2021/0189432 | A1 | 6/2021 | Shepherd et al. |
| 2021/0196809 | A1 | 7/2021 | Maianti et al. |
| 2021/0198330 | A1 | 7/2021 | Liu et al. |
| 2021/0198698 | A1 | 7/2021 | Von Maltzahn et al. |
| 2021/0214698 | A1 | 7/2021 | Liu et al. |
| 2021/0214713 | A9 | 7/2021 | Bashor et al. |
| 2021/0228627 | A1 | 7/2021 | Von Maltzahn et al. |
| 2021/0230577 | A1 | 7/2021 | Liu et al. |
| 2021/0254127 | A1 | 8/2021 | Liu et al. |
| 2021/0261957 | A1 | 8/2021 | Petris et al. |
| 2021/0269790 | A1 | 9/2021 | Hotta et al. |
| 2021/0284697 | A1 | 9/2021 | Ohlmann et al. |
| 2021/0292753 | A1 | 9/2021 | Halperin et al. |
| 2021/0315994 | A1 | 10/2021 | Liu et al. |
| 2021/0317440 | A1 | 10/2021 | Liu et al. |
| 2021/0347829 | A1 | 11/2021 | Malone et al. |
| 2021/0353543 | A1 | 11/2021 | Trudeau et al. |
| 2021/0380955 | A1 | 12/2021 | Bryson et al. |
| 2022/0008557 | A1 | 1/2022 | Von Maltzahn et al. |
| 2022/0033785 | A1 | 2/2022 | Liu et al. |
| 2022/0098593 | A1 | 3/2022 | Gaudelli et al. |
| 2022/0119785 | A1 | 4/2022 | Liu et al. |
| 2022/0154158 | A1 | 5/2022 | Charpentier et al. |
| 2022/0154224 | A1 | 5/2022 | Abudayyeh et al. |
| 2022/0170013 | A1 | 6/2022 | Liu et al. |
| 2022/0177877 | A1 | 6/2022 | Church et al. |
| 2022/0186216 | A1 | 6/2022 | Dokshin et al. |
| 2022/0204975 | A1 | 6/2022 | Liu et al. |
| 2022/0213507 | A1 | 7/2022 | Liu et al. |
| 2022/0220462 | A1 | 7/2022 | Liu et al. |
| 2022/0235347 | A1 | 7/2022 | Slaymaker et al. |
| 2022/0238182 | A1 | 7/2022 | Shen et al. |
| 2022/0241328 | A1 | 8/2022 | Bandoro et al. |
| 2022/0249697 | A1 | 8/2022 | Liu et al. |
| 2022/0259617 | A1 | 8/2022 | Joung et al. |
| 2022/0282275 | A1 | 9/2022 | Liu et al. |
| 2022/0290115 | A1 | 9/2022 | Liu et al. |
| 2022/0307001 | A1 | 9/2022 | Liu et al. |
| 2022/0307003 | A1 | 9/2022 | Liu et al. |
| 2022/0315906 | A1 | 10/2022 | Liu et al. |
| 2022/0333132 | A1 | 10/2022 | Emmanuel et al. |
| 2022/0356469 | A1 | 11/2022 | Liu et al. |
| 2022/0380740 | A1 | 12/2022 | Liu et al. |
| 2022/0389062 | A1 | 12/2022 | Zhang et al. |
| 2022/0389395 | A1 | 12/2022 | Liu et al. |
| 2022/0389451 | A1 | 12/2022 | Zhang et al. |
| 2022/0403379 | A1 | 12/2022 | Doudna et al. |
| 2023/0002745 | A1 | 1/2023 | Liu et al. |
| 2023/0021641 | A1 | 1/2023 | Liu et al. |
| 2023/0056852 | A1 | 2/2023 | Liu et al. |
| 2023/0058176 | A1 | 2/2023 | Liu et al. |
| 2023/0078265 | A1 | 3/2023 | Liu et al. |
| 2023/0086199 | A1 | 3/2023 | Liu et al. |
| 2023/0090221 | A1 | 3/2023 | Liu et al. |
| 2023/0108687 | A1 | 4/2023 | Liu et al. |
| 2023/0123669 | A1 | 4/2023 | Liu et al. |
| 2023/0127008 | A1 | 4/2023 | Liu et al. |
| 2023/0159913 | A1 | 5/2023 | Liu et al. |
| 2023/0193295 | A1 | 6/2023 | Maianti et al. |
| 2023/0220374 | A1 | 7/2023 | Liu et al. |
| 2023/0272425 | A1 | 8/2023 | Liu et al. |
| 2023/0279443 | A1 | 9/2023 | Liu et al. |
| 2023/0332144 | A1 | 10/2023 | Liu et al. |
| 2023/0340465 | A1 | 10/2023 | Liu et al. |
| 2023/0340466 | A1 | 10/2023 | Liu et al. |
| 2023/0340467 | A1 | 10/2023 | Liu et al. |
| 2023/0348883 | A1 | 11/2023 | Liu et al. |
| 2023/0357766 | A1 | 11/2023 | Liu et al. |
| 2023/0383289 | A1 | 11/2023 | Liu et al. |
| 2024/0035017 | A1 | 2/2024 | Liu et al. |
| 2024/0076652 | A1 | 3/2024 | Liu et al. |

(56) References Cited

U.S. PATENT DOCUMENTS

| | | | |
|---|---|---|---|
| 2024/0110166 | A1 | 4/2024 | Maianti et al. |
| 2024/0124866 | A1 | 4/2024 | Liu et al. |
| 2024/0173430 | A1 | 5/2024 | Liu et al. |
| 2024/0209329 | A1 | 6/2024 | Liu et al. |
| 2024/0229077 | A1 | 7/2024 | Liu et al. |
| 2024/0271116 | A1 | 8/2024 | Maianti et al. |
| 2024/0287487 | A1 | 8/2024 | Liu et al. |
| 2024/0327872 | A1 | 10/2024 | Liu et al. |
| 2024/0401018 | A1* | 12/2024 | Liu .......................... C12N 9/14 |
| 2024/0417715 | A1 | 12/2024 | Liu et al. |
| 2024/0417719 | A1 | 12/2024 | Liu et al. |
| 2024/0417753 | A1 | 12/2024 | Liu et al. |
| 2025/0027114 | A1 | 1/2025 | Liu et al. |
| 2025/0034549 | A1 | 1/2025 | Liu et al. |
| 2025/0059244 | A1 | 2/2025 | Liu et al. |
| 2025/0064979 | A1 | 2/2025 | Liu et al. |
| 2025/0064981 | A1 | 2/2025 | Liu et al. |
| 2025/0084399 | A1 | 3/2025 | Liu et al. |
| 2025/0084400 | A1 | 3/2025 | Liu et al. |
| 2025/0090687 | A1 | 3/2025 | Liu et al. |
| 2025/0092374 | A1 | 3/2025 | Liu et al. |
| 2025/0092382 | A1 | 3/2025 | Liu et al. |
| 2025/0101395 | A1 | 3/2025 | Liu et al. |
| 2025/0215418 | A1 | 7/2025 | Liu et al. |
| 2025/0228981 | A1 | 7/2025 | Liu et al. |
| 2025/0236855 | A1 | 7/2025 | Liu et al. |
| 2025/0263680 | A1 | 8/2025 | Liu et al. |
| 2025/0270527 | A1 | 8/2025 | Liu et al. |
| 2025/0270593 | A1 | 8/2025 | Liu et al. |
| 2025/0313821 | A1 | 10/2025 | Liu et al. |
| 2025/0327045 | A1 | 10/2025 | Liu et al. |
| 2025/0333718 | A1 | 10/2025 | Liu et al. |

FOREIGN PATENT DOCUMENTS

| | | | |
|---|---|---|---|
| AU | 2015101792 | A4 | 1/2016 |
| AU | 2012354062 | B2 | 9/2017 |
| BR | 112015013786 | A2 | 7/2017 |
| CA | 2480696 | A1 | 10/2003 |
| CA | 2894668 | A1 | 6/2014 |
| CA | 2894681 | A1 | 6/2014 |
| CA | 2894684 | A1 | 6/2014 |
| CA | 2852593 | A1 | 11/2015 |
| CA | 3193022 | A1 | 3/2022 |
| CA | 3219487 | A1 | 12/2022 |
| CA | 2865578 | C | 1/2023 |
| CN | 1069962 | A | 3/1993 |
| CN | 101460619 | A | 6/2009 |
| CN | 101873862 | A | 10/2010 |
| CN | 102057039 | A | 5/2011 |
| CN | 102892777 | A | 1/2013 |
| CN | 103224947 | A | 7/2013 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 103911376 | A | 7/2014 |
| CN | 103923911 | A | 7/2014 |
| CN | 103088008 | A | 8/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 104404036 | A | 3/2015 |
| CN | 104450774 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104725626 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039339 | A | 11/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105121648 | A | 12/2015 |
| CN | 105132427 | A | 12/2015 |
| CN | 105132451 | A | 12/2015 |
| CN | 105177038 | A | 12/2015 |
| CN | 105177126 | A | 12/2015 |
| CN | 105210981 | A | 1/2016 |
| CN | 105219799 | A | 1/2016 |
| CN | 105238806 | A | 1/2016 |
| CN | 105255937 | A | 1/2016 |
| CN | 105274144 | A | 1/2016 |
| CN | 105296518 | A | 2/2016 |
| CN | 105296537 | A | 2/2016 |
| CN | 105316324 | A | 2/2016 |
| CN | 105316327 | A | 2/2016 |
| CN | 105316337 | A | 2/2016 |
| CN | 105331607 | A | 2/2016 |
| CN | 105331608 | A | 2/2016 |
| CN | 105331609 | A | 2/2016 |
| CN | 105331627 | A | 2/2016 |
| CN | 105400773 | A | 3/2016 |
| CN | 105400779 | A | 3/2016 |
| CN | 105400810 | A | 3/2016 |
| CN | 105441451 | A | 3/2016 |
| CN | 105462968 | A | 4/2016 |
| CN | 105463003 | A | 4/2016 |
| CN | 105463027 | A | 4/2016 |
| CN | 105492608 | A | 4/2016 |
| CN | 105492609 | A | 4/2016 |
| CN | 105505976 | A | 4/2016 |
| CN | 105505979 | A | 4/2016 |
| CN | 105518134 | A | 4/2016 |
| CN | 105518135 | A | 4/2016 |
| CN | 105518137 | A | 4/2016 |
| CN | 105518138 | A | 4/2016 |
| CN | 105518139 | A | 4/2016 |
| CN | 105518140 | A | 4/2016 |
| CN | 105543228 | A | 5/2016 |
| CN | 105543266 | A | 5/2016 |
| CN | 105543270 | A | 5/2016 |
| CN | 105567688 | A | 5/2016 |
| CN | 105567689 | A | 5/2016 |
| CN | 105567734 | A | 5/2016 |
| CN | 105567735 | A | 5/2016 |
| CN | 105567738 | A | 5/2016 |
| CN | 105593367 | A | 5/2016 |
| CN | 105594664 | A | 5/2016 |
| CN | 105602987 | A | 5/2016 |
| CN | 105624146 | A | 6/2016 |

(56) References Cited

FOREIGN PATENT DOCUMENTS

| | | | |
|---|---|---|---|
| CN | 105624187 | A | 6/2016 |
| CN | 105646719 | A | 6/2016 |
| CN | 105647922 | A | 6/2016 |
| CN | 105647962 | A | 6/2016 |
| CN | 105647968 | A | 6/2016 |
| CN | 105647969 | A | 6/2016 |
| CN | 105671070 | A | 6/2016 |
| CN | 105671083 | A | 6/2016 |
| CN | 105695485 | A | 6/2016 |
| CN | 105779448 | A | 7/2016 |
| CN | 105779449 | A | 7/2016 |
| CN | 105802980 | A | 7/2016 |
| CN | 105821039 | A | 8/2016 |
| CN | 105821040 | A | 8/2016 |
| CN | 105821049 | A | 8/2016 |
| CN | 105821072 | A | 8/2016 |
| CN | 105821075 | A | 8/2016 |
| CN | 105821116 | A | 8/2016 |
| CN | 105838733 | A | 8/2016 |
| CN | 105861547 | A | 8/2016 |
| CN | 105861552 | A | 8/2016 |
| CN | 105861554 | A | 8/2016 |
| CN | 105886498 | A | 8/2016 |
| CN | 105886534 | A | 8/2016 |
| CN | 105886616 | A | 8/2016 |
| CN | 105907758 | A | 8/2016 |
| CN | 105907785 | A | 8/2016 |
| CN | 105925608 | A | 9/2016 |
| CN | 105934516 | A | 9/2016 |
| CN | 105950560 | A | 9/2016 |
| CN | 105950626 | A | 9/2016 |
| CN | 105950633 | A | 9/2016 |
| CN | 105950639 | A | 9/2016 |
| CN | 105985985 | A | 10/2016 |
| CN | 106011104 | A | 10/2016 |
| CN | 106011150 | A | 10/2016 |
| CN | 106011167 | A | 10/2016 |
| CN | 106011171 | A | 10/2016 |
| CN | 106032540 | A | 10/2016 |
| CN | 106047803 | A | 10/2016 |
| CN | 106047877 | A | 10/2016 |
| CN | 106047930 | A | 10/2016 |
| CN | 106086008 | A | 11/2016 |
| CN | 106086028 | A | 11/2016 |
| CN | 106086061 | A | 11/2016 |
| CN | 106086062 | A | 11/2016 |
| CN | 106103475 | A | 11/2016 |
| CN | 106109417 | A | 11/2016 |
| CN | 106119275 | A | 11/2016 |
| CN | 106119283 | A | 11/2016 |
| CN | 106148286 | A | 11/2016 |
| CN | 106148370 | A | 11/2016 |
| CN | 106148416 | A | 11/2016 |
| CN | 106167525 | A | 11/2016 |
| CN | 106167808 | A | 11/2016 |
| CN | 106167810 | A | 11/2016 |
| CN | 106167821 | A | 11/2016 |
| CN | 106172238 | A | 12/2016 |
| CN | 106190903 | A | 12/2016 |
| CN | 106191057 | A | 12/2016 |
| CN | 106191061 | A | 12/2016 |
| CN | 106191062 | A | 12/2016 |
| CN | 106191064 | A | 12/2016 |
| CN | 106191071 | A | 12/2016 |
| CN | 106191099 | A | 12/2016 |
| CN | 106191107 | A | 12/2016 |
| CN | 106191113 | A | 12/2016 |
| CN | 106191114 | A | 12/2016 |
| CN | 106191116 | A | 12/2016 |
| CN | 106191124 | A | 12/2016 |
| CN | 106222177 | A | 12/2016 |
| CN | 106222193 | A | 12/2016 |
| CN | 106222203 | A | 12/2016 |
| CN | 106232823 | A | 12/2016 |
| CN | 106244555 | A | 12/2016 |
| CN | 106244557 | A | 12/2016 |
| CN | 106244591 | A | 12/2016 |
| CN | 106244609 | A | 12/2016 |
| CN | 106282241 | A | 1/2017 |
| CN | 106318934 | A | 1/2017 |
| CN | 106318973 | A | 1/2017 |
| CN | 106350540 | A | 1/2017 |
| CN | 106367435 | A | 2/2017 |
| CN | 106399306 | A | 2/2017 |
| CN | 106399311 | A | 2/2017 |
| CN | 106399360 | A | 2/2017 |
| CN | 106399367 | A | 2/2017 |
| CN | 106399375 | A | 2/2017 |
| CN | 106399377 | A | 2/2017 |
| CN | 106434651 | A | 2/2017 |
| CN | 106434663 | A | 2/2017 |
| CN | 106434688 | A | 2/2017 |
| CN | 106434737 | A | 2/2017 |
| CN | 106434748 | A | 2/2017 |
| CN | 106434752 | A | 2/2017 |
| CN | 106434782 | A | 2/2017 |
| CN | 106446600 | A | 2/2017 |
| CN | 106479985 | A | 3/2017 |
| CN | 106480027 | A | 3/2017 |
| CN | 106480036 | A | 3/2017 |
| CN | 106480067 | A | 3/2017 |
| CN | 106480080 | A | 3/2017 |
| CN | 106480083 | A | 3/2017 |
| CN | 106480097 | A | 3/2017 |
| CN | 106544351 | A | 3/2017 |
| CN | 106544353 | A | 3/2017 |
| CN | 106544357 | A | 3/2017 |
| CN | 106554969 | A | 4/2017 |
| CN | 106566838 | A | 4/2017 |
| CN | 106701763 | A | 5/2017 |
| CN | 106701808 | A | 5/2017 |
| CN | 106701818 | A | 5/2017 |
| CN | 106701823 | A | 5/2017 |
| CN | 106701830 | A | 5/2017 |
| CN | 106754912 | A | 5/2017 |
| CN | 106755026 | A | 5/2017 |
| CN | 106755077 | A | 5/2017 |
| CN | 106755088 | A | 5/2017 |
| CN | 106755091 | A | 5/2017 |
| CN | 106755097 | A | 5/2017 |
| CN | 106755424 | A | 5/2017 |
| CN | 106801056 | A | 6/2017 |
| CN | 106834323 | A | 6/2017 |
| CN | 106834341 | A | 6/2017 |
| CN | 106834347 | A | 6/2017 |
| CN | 106845151 | A | 6/2017 |
| CN | 106868008 | A | 6/2017 |
| CN | 106868031 | A | 6/2017 |
| CN | 106906240 | A | 6/2017 |
| CN | 106906242 | A | 6/2017 |
| CN | 106916820 | A | 7/2017 |
| CN | 106916852 | A | 7/2017 |
| CN | 106939303 | A | 7/2017 |
| CN | 106947750 | A | 7/2017 |
| CN | 106947780 | A | 7/2017 |
| CN | 106957830 | A | 7/2017 |
| CN | 106957831 | A | 7/2017 |
| CN | 106957844 | A | 7/2017 |
| CN | 106957855 | A | 7/2017 |
| CN | 106957858 | A | 7/2017 |
| CN | 106967697 | A | 7/2017 |
| CN | 106967726 | A | 7/2017 |
| CN | 106978428 | A | 7/2017 |
| CN | 106987570 | A | 7/2017 |
| CN | 106987757 | A | 7/2017 |
| CN | 107012164 | A | 8/2017 |
| CN | 107012174 | A | 8/2017 |
| CN | 107012213 | A | 8/2017 |
| CN | 107012250 | A | 8/2017 |
| CN | 107022562 | A | 8/2017 |
| CN | 107034188 | A | 8/2017 |
| CN | 107034218 | A | 8/2017 |
| CN | 107034229 | A | 8/2017 |
| CN | 107043775 | A | 8/2017 |

(56) References Cited

FOREIGN PATENT DOCUMENTS

| | | | |
|---|---|---|---|
| CN | 107043779 | A | 8/2017 |
| CN | 107043787 | A | 8/2017 |
| CN | 107058320 | A | 8/2017 |
| CN | 107058328 | A | 8/2017 |
| CN | 107058358 | A | 8/2017 |
| CN | 107058372 | A | 8/2017 |
| CN | 107083392 | A | 8/2017 |
| CN | 107099533 | A | 8/2017 |
| CN | 107099850 | A | 8/2017 |
| CN | 107119053 | A | 9/2017 |
| CN | 107119071 | A | 9/2017 |
| CN | 107129999 | A | 9/2017 |
| CN | 107130000 | A | 9/2017 |
| CN | 107142272 | A | 9/2017 |
| CN | 107142282 | A | 9/2017 |
| CN | 107177591 | A | 9/2017 |
| CN | 107177595 | A | 9/2017 |
| CN | 107177625 | A | 9/2017 |
| CN | 107177631 | A | 9/2017 |
| CN | 107190006 | A | 9/2017 |
| CN | 107190008 | A | 9/2017 |
| CN | 107217042 | A | 9/2017 |
| CN | 107217075 | A | 9/2017 |
| CN | 107227307 | A | 10/2017 |
| CN | 107227352 | A | 10/2017 |
| CN | 107236737 | A | 10/2017 |
| CN | 107236739 | A | 10/2017 |
| CN | 107236741 | A | 10/2017 |
| CN | 107245502 | A | 10/2017 |
| CN | 107254485 | A | 10/2017 |
| CN | 107266541 | A | 10/2017 |
| CN | 107267515 | A | 10/2017 |
| CN | 107287245 | A | 10/2017 |
| CN | 107298701 | A | 10/2017 |
| CN | 107299114 | A | 10/2017 |
| CN | 107304435 | A | 10/2017 |
| CN | 107312785 | A | 11/2017 |
| CN | 107312793 | A | 11/2017 |
| CN | 107312795 | A | 11/2017 |
| CN | 107312798 | A | 11/2017 |
| CN | 107326042 | A | 11/2017 |
| CN | 107326046 | A | 11/2017 |
| CN | 107354156 | A | 11/2017 |
| CN | 107354173 | A | 11/2017 |
| CN | 107356793 | A | 11/2017 |
| CN | 107362372 | A | 11/2017 |
| CN | 107365786 | A | 11/2017 |
| CN | 107365804 | A | 11/2017 |
| CN | 107384894 | A | 11/2017 |
| CN | 107384922 | A | 11/2017 |
| CN | 107384926 | A | 11/2017 |
| CN | 107400677 | A | 11/2017 |
| CN | 107418974 | A | 12/2017 |
| CN | 107435051 | A | 12/2017 |
| CN | 107435069 | A | 12/2017 |
| CN | 107446922 | A | 12/2017 |
| CN | 107446924 | A | 12/2017 |
| CN | 107446932 | A | 12/2017 |
| CN | 107446951 | A | 12/2017 |
| CN | 107446954 | A | 12/2017 |
| CN | 107460196 | A | 12/2017 |
| CN | 107474129 | A | 12/2017 |
| CN | 107475300 | A | 12/2017 |
| CN | 107488649 | A | 12/2017 |
| CN | 107502608 | A | 12/2017 |
| CN | 107502618 | A | 12/2017 |
| CN | 107513531 | A | 12/2017 |
| CN | 107519492 | A | 12/2017 |
| CN | 107523567 | A | 12/2017 |
| CN | 107523583 | A | 12/2017 |
| CN | 107541525 | A | 1/2018 |
| CN | 107557373 | A | 1/2018 |
| CN | 107557378 | A | 1/2018 |
| CN | 107557381 | A | 1/2018 |
| CN | 107557390 | A | 1/2018 |
| CN | 107557393 | A | 1/2018 |
| CN | 107557394 | A | 1/2018 |
| CN | 107557455 | A | 1/2018 |
| CN | 107574179 | A | 1/2018 |
| CN | 107586777 | A | 1/2018 |
| CN | 107586779 | A | 1/2018 |
| CN | 107604003 | A | 1/2018 |
| CN | 107619829 | A | 1/2018 |
| CN | 107619837 | A | 1/2018 |
| CN | 107630006 | A | 1/2018 |
| CN | 107630041 | A | 1/2018 |
| CN | 107630042 | A | 1/2018 |
| CN | 107630043 | A | 1/2018 |
| CN | 107641631 | A | 1/2018 |
| CN | 107653256 | A | 2/2018 |
| CN | 107686848 | A | 2/2018 |
| CN | 206970581 | A | 2/2018 |
| CN | 107760652 | A | 3/2018 |
| CN | 107760663 | A | 3/2018 |
| CN | 107760684 | A | 3/2018 |
| CN | 107760715 | A | 3/2018 |
| CN | 107784200 | A | 3/2018 |
| CN | 107794272 | A | 3/2018 |
| CN | 107794276 | A | 3/2018 |
| CN | 107815463 | A | 3/2018 |
| CN | 107828738 | A | 3/2018 |
| CN | 107828794 | A | 3/2018 |
| CN | 107828826 | A | 3/2018 |
| CN | 107828874 | A | 3/2018 |
| CN | 107858346 | A | 3/2018 |
| CN | 107858373 | A | 3/2018 |
| CN | 107880132 | A | 4/2018 |
| CN | 107881184 | A | 4/2018 |
| CN | 107893074 | A | 4/2018 |
| CN | 107893075 | A | 4/2018 |
| CN | 107893076 | A | 4/2018 |
| CN | 107893080 | A | 4/2018 |
| CN | 107893086 | A | 4/2018 |
| CN | 107904261 | A | 4/2018 |
| CN | 107937427 | A | 4/2018 |
| CN | 107937432 | A | 4/2018 |
| CN | 107937501 | A | 4/2018 |
| CN | 107974466 | A | 5/2018 |
| CN | 107988229 | A | 5/2018 |
| CN | 107988246 | A | 5/2018 |
| CN | 107988256 | A | 5/2018 |
| CN | 107988268 | A | 5/2018 |
| CN | 108018316 | A | 5/2018 |
| CN | 108034656 | A | 5/2018 |
| CN | 108048466 | A | 5/2018 |
| CN | 108102940 | A | 6/2018 |
| CN | 108103090 | A | 6/2018 |
| CN | 108103092 | A | 6/2018 |
| CN | 108103098 | A | 6/2018 |
| CN | 108103586 | A | 6/2018 |
| CN | 108148835 | A | 6/2018 |
| CN | 108148837 | A | 6/2018 |
| CN | 108148873 | A | 6/2018 |
| CN | 108192956 | A | 6/2018 |
| CN | 108243575 | A | 7/2018 |
| CN | 108251423 | A | 7/2018 |
| CN | 108251451 | A | 7/2018 |
| CN | 108251452 | A | 7/2018 |
| CN | 108342480 | A | 7/2018 |
| CN | 108359691 | A | 8/2018 |
| CN | 108359712 | A | 8/2018 |
| CN | 108384784 | A | 8/2018 |
| CN | 108396027 | A | 8/2018 |
| CN | 108410877 | A | 8/2018 |
| CN | 108410906 | A | 8/2018 |
| CN | 108410907 | A | 8/2018 |
| CN | 108410911 | A | 8/2018 |
| CN | 108424931 | A | 8/2018 |
| CN | 108441519 | A | 8/2018 |
| CN | 108441520 | A | 8/2018 |
| CN | 108472314 | A | 8/2018 |
| CN | 108405693 | A | 9/2018 |
| CN | 108486108 | A | 9/2018 |
| CN | 108486111 | A | 9/2018 |

(56) References Cited

FOREIGN PATENT DOCUMENTS

| | | | | |
|---|---|---|---|---|
| CN | 108486145 | A | 9/2018 | |
| CN | 108486146 | A | 9/2018 | |
| CN | 108486154 | A | 9/2018 | |
| CN | 108486159 | A | 9/2018 | |
| CN | 108486234 | A | 9/2018 | |
| CN | 108504657 | A | 9/2018 | |
| CN | 108504685 | A | 9/2018 | |
| CN | 108513575 | A | 9/2018 | |
| CN | 108546712 | A | 9/2018 | |
| CN | 108546717 | A | 9/2018 | |
| CN | 108546718 | A | 9/2018 | |
| CN | 108559730 | A | 9/2018 | |
| CN | 108559732 | A | 9/2018 | |
| CN | 108559745 | A | 9/2018 | |
| CN | 108559760 | A | 9/2018 | |
| CN | 108570479 | A | 9/2018 | |
| CN | 108588071 | A | 9/2018 | |
| CN | 108588123 | A | 9/2018 | |
| CN | 108588128 | A | 9/2018 | |
| CN | 108588182 | A | 9/2018 | |
| CN | 108610399 | A | 10/2018 | |
| CN | 108611364 | A | 10/2018 | |
| CN | 108624622 | A | 10/2018 | |
| CN | 108642053 | A | 10/2018 | |
| CN | 108642055 | A | 10/2018 | |
| CN | 108642077 | A | 10/2018 | |
| CN | 108642078 | A | 10/2018 | |
| CN | 108642090 | A | 10/2018 | |
| CN | 108690844 | A | 10/2018 | |
| CN | 108699542 | A | 10/2018 | |
| CN | 108707604 | A | 10/2018 | |
| CN | 108707620 | A | 10/2018 | |
| CN | 108707621 | A | 10/2018 | |
| CN | 108707628 | A | 10/2018 | |
| CN | 108707629 | A | 10/2018 | |
| CN | 108715850 | A | 10/2018 | |
| CN | 108728476 | A | 11/2018 | |
| CN | 108728486 | A | 11/2018 | |
| CN | 108753772 | A | 11/2018 | |
| CN | 108753783 | A | 11/2018 | |
| CN | 108753813 | A | 11/2018 | |
| CN | 108753817 | A | 11/2018 | |
| CN | 108753832 | A | 11/2018 | |
| CN | 108753835 | A | 11/2018 | |
| CN | 108753836 | A | 11/2018 | |
| CN | 108795902 | A | 11/2018 | |
| CN | 108822217 | A | 11/2018 | |
| CN | 108823248 | A | 11/2018 | |
| CN | 108823249 | A | 11/2018 | |
| CN | 108823291 | A | 11/2018 | |
| CN | 108841845 | A | 11/2018 | |
| CN | 108853133 | A | 11/2018 | |
| CN | 108866093 | A | 11/2018 | |
| CN | 108893529 | A | 11/2018 | |
| CN | 108913664 | A | 11/2018 | |
| CN | 108913691 | A | 11/2018 | |
| CN | 108913714 | A | 11/2018 | |
| CN | 108913717 | A | 11/2018 | |
| CN | 208034188 | U | 11/2018 | |
| CN | 107446923 | A | 12/2018 | |
| CN | 109504707 | A * | 3/2019 | ............ C12N 15/85 |
| CN | 109517841 | A | 3/2019 | |
| CN | 111471745 | A | 7/2020 | |
| EP | 0264166 | A1 | 4/1988 | |
| EP | 0321201 | B2 | 6/1989 | |
| EP | 0519463 | A1 | 12/1992 | |
| EP | 1085892 | A2 | 3/2001 | |
| EP | 1092770 | A2 | 4/2001 | |
| EP | 2350295 | B1 | 5/2013 | |
| EP | 2604255 | A1 | 6/2013 | |
| EP | 2840140 | A1 | 2/2015 | |
| EP | 2877490 | A2 | 6/2015 | |
| EP | 2966170 | A1 | 1/2016 | |
| EP | 3009511 | A2 | 4/2016 | |
| EP | 3031921 | A1 | 6/2016 | |
| EP | 3045537 | A1 | 7/2016 | |
| EP | 3115457 | A1 | 1/2017 | |
| EP | 3144390 | A1 | 3/2017 | |
| EP | 2583974 | B1 | 4/2017 | |
| EP | 3199632 | A1 | 8/2017 | |
| EP | 3216867 | A1 | 9/2017 | |
| EP | 3235828 | A1 | 10/2017 | |
| EP | 3252160 | A1 | 12/2017 | |
| EP | 2498823 | B1 | 8/2018 | |
| EP | 3365437 | A1 | 8/2018 | |
| EP | 3454889 | A2 | 3/2019 | |
| EP | 3008192 | B1 | 7/2019 | |
| EP | 3079725 | B1 | 10/2019 | |
| EP | 3450553 | B1 | 12/2019 | |
| EP | 3622079 | A1 | 3/2020 | |
| EP | 3389700 | B1 | 11/2020 | |
| EP | 3294756 | B1 | 12/2020 | |
| EP | 3752623 | A1 | 12/2020 | |
| EP | 2776567 | B1 | 1/2021 | |
| EP | 3177726 | B1 | 1/2021 | |
| EP | 3788155 | A1 | 3/2021 | |
| EP | 3793570 | A2 | 3/2021 | |
| EP | 3455239 | B1 | 4/2021 | |
| EP | 3820995 | A1 | 5/2021 | |
| EP | 3844272 | A1 | 7/2021 | |
| EP | 3856898 | A1 | 8/2021 | |
| EP | 3880717 | A1 | 9/2021 | |
| EP | 3880831 | A1 | 9/2021 | |
| EP | 4031561 | A1 | 7/2022 | |
| ES | 2740248 | T3 | 2/2020 | |
| GB | 2528177 | A | 1/2016 | |
| GB | 2531454 | A1 | 4/2016 | |
| GB | 2542653 | A | 3/2017 | |
| HK | 1208045 | A1 | 2/2016 | |
| JP | 2007-501626 | A | 2/2007 | |
| JP | 2008-515405 | A | 5/2008 | |
| JP | 2010-033344 | A | 2/2010 | |
| JP | 2010-521978 | A | 7/2010 | |
| JP | 2010-535744 | A | 11/2010 | |
| JP | 2010-539929 | A | 12/2010 | |
| JP | 2011-081011 | A | 4/2011 | |
| JP | 2011-523353 | A | 8/2011 | |
| JP | 2012-525146 | A | 10/2012 | |
| JP | 2012-210172 | A | 11/2012 | |
| JP | 2012-531909 | A | 12/2012 | |
| JP | 2015-523856 | A | 8/2015 | |
| JP | 2015-532654 | A | 11/2015 | |
| JP | 2016-525888 | A | 9/2016 | |
| JP | 2016-533760 | A | 11/2016 | |
| JP | 2016-534132 | A | 11/2016 | |
| JP | 2017-500035 | A | 1/2017 | |
| JP | 2018-521045 | A | 8/2018 | |
| JP | 2019-506123 | A | 2/2019 | |
| JP | 6629734 | B2 | 1/2020 | |
| JP | 6633524 | B2 | 1/2020 | |
| JP | 6830517 | B2 | 2/2021 | |
| JP | 2021-523739 | A | 9/2021 | |
| JP | 7324523 | B2 | 8/2023 | |
| KR | 101584933 | B1 | 1/2016 | |
| KR | 2016-0050069 | A | 5/2016 | |
| KR | 20160133380 | A | 11/2016 | |
| KR | 20170037025 | A | 4/2017 | |
| KR | 20170037028 | A | 4/2017 | |
| KR | 101748575 | B1 | 6/2017 | |
| KR | 20170128137 | A | 11/2017 | |
| KR | 2018-0022465 | A | 3/2018 | |
| RU | 2016104674 | A | 8/2017 | |
| RU | 2634395 | C1 | 10/2017 | |
| RU | 2652899 | C1 | 5/2018 | |
| RU | 2015128057 | A | 3/2019 | |
| RU | 2015128098 | A | 3/2019 | |
| RU | 2687451 | C1 | 5/2019 | |
| RU | 2019112514 | A | 6/2019 | |
| RU | 2019127300 | A | 9/2019 | |
| RU | 2701850 | C2 | 10/2019 | |
| SG | 10201707569Y | A | 10/2017 | |
| SG | 10201710486X | A | 1/2018 | |
| SG | 10201710487V | A | 1/2018 | |
| SG | 10201710488T | A | 1/2018 | |

(56) References Cited

FOREIGN PATENT DOCUMENTS

| | | | |
|---|---|---|---|
| TW | I608100 | B | 12/2017 |
| TW | 201809272 | A | 3/2018 |
| TW | 2018-29773 | A | 8/2018 |
| WO | WO 1990/002809 | A1 | 3/1990 |
| WO | WO 1991/003162 | A1 | 3/1991 |
| WO | WO 1991/016024 | A1 | 10/1991 |
| WO | WO 1991/017271 | A1 | 11/1991 |
| WO | WO 1991/017424 | A1 | 11/1991 |
| WO | WO 1992/006188 | A2 | 4/1992 |
| WO | WO 1992/006200 | A1 | 4/1992 |
| WO | WO 1992/007065 | A1 | 4/1992 |
| WO | WO 1993/015187 | A1 | 8/1993 |
| WO | WO 1993/024641 | A2 | 12/1993 |
| WO | WO 1994/018316 | A2 | 8/1994 |
| WO | WO 1994/026877 | A1 | 11/1994 |
| WO | WO 1996/004403 | A1 | 2/1996 |
| WO | WO 1996/010640 | A1 | 4/1996 |
| WO | WO 1997/025416 | A2 | 7/1997 |
| WO | WO 1998/032845 | A1 | 7/1998 |
| WO | WO 1998/050538 | A1 | 11/1998 |
| WO | WO 1998/053058 | A1 | 11/1998 |
| WO | WO 1998/053059 | A1 | 11/1998 |
| WO | WO 1998/053060 | A1 | 11/1998 |
| WO | WO 2001/036452 | A2 | 5/2001 |
| WO | WO 2001/038547 | A2 | 5/2001 |
| WO | WO 2001/083692 | A2 | 11/2001 |
| WO | WO 2002/016536 | A1 | 2/2002 |
| WO | WO 2002/059296 | A2 | 8/2002 |
| WO | WO 2002/068676 | A2 | 9/2002 |
| WO | WO 2002/103028 | A2 | 12/2002 |
| WO | WO 2003/004608 | A2 | 1/2003 |
| WO | WO 2003/016496 | A2 | 2/2003 |
| WO | WO 2004/007684 | A2 | 1/2004 |
| WO | WO 2005/014791 | A2 | 2/2005 |
| WO | WO 2005/019415 | A2 | 3/2005 |
| WO | WO 2006/002547 | A1 | 1/2006 |
| WO | WO 2006/042112 | A2 | 4/2006 |
| WO | WO 2007/025097 | A2 | 3/2007 |
| WO | WO 2007/037444 | A1 | 4/2007 |
| WO | WO 2007/066923 | A1 | 6/2007 |
| WO | WO 2007/136815 | A2 | 11/2007 |
| WO | WO 2007/143574 | A1 | 12/2007 |
| WO | WO 2008/005529 | A2 | 1/2008 |
| WO | WO 2008/108989 | A2 | 9/2008 |
| WO | WO 2009/002418 | A2 | 12/2008 |
| WO | WO 2009/019317 | A1 | 2/2009 |
| WO | WO 2009/098290 | A1 | 8/2009 |
| WO | WO 2009/134808 | A2 | 11/2009 |
| WO | WO 2010/011961 | A2 | 1/2010 |
| WO | WO 2010/012902 | A1 | 2/2010 |
| WO | WO 2010/028347 | A2 | 3/2010 |
| WO | WO 2010/054108 | A2 | 5/2010 |
| WO | WO 2010/054154 | A2 | 5/2010 |
| WO | WO 2010/068289 | A2 | 6/2010 |
| WO | WO 2010/075424 | A2 | 7/2010 |
| WO | WO 2010/091122 | A1 | 8/2010 |
| WO | WO 2010/102257 | A2 | 9/2010 |
| WO | WO 2010/104749 | A2 | 9/2010 |
| WO | WO 2010/129019 | A2 | 11/2010 |
| WO | WO 2010/129023 | A2 | 11/2010 |
| WO | WO 2010/132092 | A2 | 11/2010 |
| WO | WO 2010/144150 | A2 | 12/2010 |
| WO | WO 2011/002503 | A1 | 1/2011 |
| WO | WO 2011/017293 | A2 | 2/2011 |
| WO | WO 2011/053868 | A1 | 5/2011 |
| WO | WO 2011/053982 | A2 | 5/2011 |
| WO | WO 2011/068810 | A1 | 6/2011 |
| WO | WO 2011/075627 | A1 | 6/2011 |
| WO | WO 2011/091311 | A2 | 7/2011 |
| WO | WO 2011/091396 | A1 | 7/2011 |
| WO | WO 2011/109031 | A1 | 9/2011 |
| WO | WO 2011/143124 | A2 | 11/2011 |
| WO | WO 2011/147590 | A2 | 12/2011 |
| WO | WO 2011/159369 | A1 | 12/2011 |
| WO | WO 2012/054726 | A1 | 4/2012 |
| WO | WO 2012/061815 | A2 | 5/2012 |
| WO | WO 2012/065043 | A2 | 5/2012 |
| WO | WO 2012/088381 | A2 | 6/2012 |
| WO | WO 2012/125445 | A2 | 9/2012 |
| WO | WO 2012/138927 | A2 | 10/2012 |
| WO | WO 2012/149470 | A1 | 11/2012 |
| WO | WO 2012/158985 | A2 | 11/2012 |
| WO | WO 2012/158986 | A2 | 11/2012 |
| WO | WO 2012/164565 | A1 | 12/2012 |
| WO | WO 2012/170930 | A1 | 12/2012 |
| WO | WO 2013/012674 | A1 | 1/2013 |
| WO | WO 2013/013105 | A1 | 1/2013 |
| WO | WO 2013/039857 | A1 | 3/2013 |
| WO | WO 2013/039861 | A2 | 3/2013 |
| WO | WO 2013/040093 | A2 | 3/2013 |
| WO | WO 2013/045632 | A1 | 4/2013 |
| WO | WO 2013/047844 | A1 | 4/2013 |
| WO | WO 2013/066438 | A2 | 5/2013 |
| WO | WO 2013/086441 | A2 | 6/2013 |
| WO | WO 2013/086444 | A2 | 6/2013 |
| WO | WO 2013/098244 | A1 | 7/2013 |
| WO | WO 2013/119602 | A1 | 8/2013 |
| WO | WO 2013/120022 | A2 | 8/2013 |
| WO | WO 2013/122617 | A1 | 8/2013 |
| WO | WO 2013/126794 | A1 | 8/2013 |
| WO | WO 2013/130683 | A2 | 9/2013 |
| WO | WO 2013/130824 | A1 | 9/2013 |
| WO | WO 2013/141680 | A1 | 9/2013 |
| WO | WO 2013/142578 | A2 | 9/2013 |
| WO | WO 2013/152359 | A1 | 10/2013 |
| WO | WO 2013/160230 | A1 | 10/2013 |
| WO | WO 2013/166315 | A1 | 11/2013 |
| WO | WO 2013/169398 | A2 | 11/2013 |
| WO | WO 2013/169802 | A1 | 11/2013 |
| WO | WO 2013/176772 | A2 | 11/2013 |
| WO | WO 2013/176915 | A1 | 11/2013 |
| WO | WO 2013/176916 | A1 | 11/2013 |
| WO | WO 2013/181440 | A1 | 12/2013 |
| WO | WO 2013/186754 | A2 | 12/2013 |
| WO | WO 2013/188037 | A2 | 12/2013 |
| WO | WO 2013/188522 | A2 | 12/2013 |
| WO | WO 2013/188638 | A2 | 12/2013 |
| WO | WO 2013/192278 | A1 | 12/2013 |
| WO | WO 2013/142378 | A9 | 1/2014 |
| WO | WO 2014/004336 | A2 | 1/2014 |
| WO | WO 2014/005042 | A2 | 1/2014 |
| WO | WO 2014/011237 | A1 | 1/2014 |
| WO | WO 2014/011901 | A2 | 1/2014 |
| WO | WO 2014/018423 | A2 | 1/2014 |
| WO | WO 2014/020608 | A1 | 2/2014 |
| WO | WO 2014/022120 | A1 | 2/2014 |
| WO | WO 2014/022702 | A2 | 2/2014 |
| WO | WO 2014/036219 | A2 | 3/2014 |
| WO | WO 2014/039513 | A2 | 3/2014 |
| WO | WO 2014/039523 | A1 | 3/2014 |
| WO | WO 2014/039585 | A2 | 3/2014 |
| WO | WO 2014/039684 | A1 | 3/2014 |
| WO | WO 2014/039692 | A2 | 3/2014 |
| WO | WO 2014/039702 | A2 | 3/2014 |
| WO | WO 2014/039872 | A1 | 3/2014 |
| WO | WO 2014/039970 | A1 | 3/2014 |
| WO | WO 2014/041327 | A1 | 3/2014 |
| WO | WO 2014/043143 | A1 | 3/2014 |
| WO | WO 2014/047103 | A2 | 3/2014 |
| WO | WO 2014/055782 | A1 | 4/2014 |
| WO | WO 2014/059173 | A2 | 4/2014 |
| WO | WO 2014/059255 | A1 | 4/2014 |
| WO | WO 2014/065596 | A1 | 5/2014 |
| WO | WO 2014/066505 | A1 | 5/2014 |
| WO | WO 2014/068346 | A2 | 5/2014 |
| WO | WO 2014/070887 | A1 | 5/2014 |
| WO | WO 2014/071006 | A1 | 5/2014 |
| WO | WO 2014/071219 | A1 | 5/2014 |
| WO | WO 2014/071235 | A1 | 5/2014 |
| WO | WO 2014/072941 | A1 | 5/2014 |
| WO | WO 2014/081729 | A1 | 5/2014 |
| WO | WO 2014/081730 | A1 | 5/2014 |
| WO | WO 2014/081855 | A1 | 5/2014 |
| WO | WO 2014/082644 | A1 | 6/2014 |

(56) References Cited

FOREIGN PATENT DOCUMENTS

| | | | |
|---|---|---|---|
| WO | WO 2014/085261 | A1 | 6/2014 |
| WO | WO 2014/085593 | A1 | 6/2014 |
| WO | WO 2014/085830 | A2 | 6/2014 |
| WO | WO 2014/089212 | A1 | 6/2014 |
| WO | WO 2014/089290 | A1 | 6/2014 |
| WO | WO 2014/089348 | A1 | 6/2014 |
| WO | WO 2014/089513 | A1 | 6/2014 |
| WO | WO 2014/089533 | A2 | 6/2014 |
| WO | WO 2014/089541 | A2 | 6/2014 |
| WO | WO 2014/093479 | A1 | 6/2014 |
| WO | WO 2014/093595 | A1 | 6/2014 |
| WO | WO 2014/093622 | A2 | 6/2014 |
| WO | WO 2014/093635 | A1 | 6/2014 |
| WO | WO 2014/093655 | A2 | 6/2014 |
| WO | WO 2014/093661 | A2 | 6/2014 |
| WO | WO 2014/093694 | A1 | 6/2014 |
| WO | WO 2014/093701 | A1 | 6/2014 |
| WO | WO 2014/093709 | A1 | 6/2014 |
| WO | WO 2014/093712 | A1 | 6/2014 |
| WO | WO 2014/093718 | A1 | 6/2014 |
| WO | WO 2014/093736 | A1 | 6/2014 |
| WO | WO 2014/093768 | A1 | 6/2014 |
| WO | WO 2014/093852 | A1 | 6/2014 |
| WO | WO 2014/096972 | A2 | 6/2014 |
| WO | WO 2014/099744 | A1 | 6/2014 |
| WO | WO 2014/099750 | A2 | 6/2014 |
| WO | WO 2014/104878 | A1 | 7/2014 |
| WO | WO 2014/110006 | A1 | 7/2014 |
| WO | WO 2014/110552 | A1 | 7/2014 |
| WO | WO 2014/113493 | A1 | 7/2014 |
| WO | WO 2014/123967 | A2 | 8/2014 |
| WO | WO 2014/124226 | A1 | 8/2014 |
| WO | WO 2014/125668 | A1 | 8/2014 |
| WO | WO 2014/127287 | A1 | 8/2014 |
| WO | WO 2014/128324 | A1 | 8/2014 |
| WO | WO 2014/128659 | A1 | 8/2014 |
| WO | WO 2014/130706 | A1 | 8/2014 |
| WO | WO 2014/130955 | A1 | 8/2014 |
| WO | WO 2014/131833 | A1 | 9/2014 |
| WO | WO 2014/138379 | A1 | 9/2014 |
| WO | WO 2014/143381 | A1 | 9/2014 |
| WO | WO 2014/144094 | A1 | 9/2014 |
| WO | WO 2014/144155 | A1 | 9/2014 |
| WO | WO 2014/144288 | A1 | 9/2014 |
| WO | WO 2014/144592 | A2 | 9/2014 |
| WO | WO 2014/144761 | A2 | 9/2014 |
| WO | WO 2014/144951 | A1 | 9/2014 |
| WO | WO 2014/145599 | A2 | 9/2014 |
| WO | WO 2014/145736 | A2 | 9/2014 |
| WO | WO 2014/150624 | A1 | 9/2014 |
| WO | WO 2014/152432 | A2 | 9/2014 |
| WO | WO 2014/152940 | A1 | 9/2014 |
| WO | WO 2014/153118 | A1 | 9/2014 |
| WO | WO 2014/153470 | A2 | 9/2014 |
| WO | WO 2014/158593 | A1 | 10/2014 |
| WO | WO 2014/161821 | A1 | 10/2014 |
| WO | WO 2014/164466 | A1 | 10/2014 |
| WO | WO 2014/165177 | A1 | 10/2014 |
| WO | WO 2014/165349 | A1 | 10/2014 |
| WO | WO 2014/165612 | A2 | 10/2014 |
| WO | WO 2014/165707 | A2 | 10/2014 |
| WO | WO 2014/165825 | A2 | 10/2014 |
| WO | WO 2014/172458 | A1 | 10/2014 |
| WO | WO 2014/172470 | A2 | 10/2014 |
| WO | WO 2014/172489 | A2 | 10/2014 |
| WO | WO 2014/173955 | A1 | 10/2014 |
| WO | WO 2014/182700 | A1 | 11/2014 |
| WO | WO 2014/183071 | A2 | 11/2014 |
| WO | WO 2014/184143 | A1 | 11/2014 |
| WO | WO 2014/184741 | A1 | 11/2014 |
| WO | WO 2014/184744 | A1 | 11/2014 |
| WO | WO 2014/186585 | A2 | 11/2014 |
| WO | WO 2014/186686 | A2 | 11/2014 |
| WO | WO 2014/190181 | A1 | 11/2014 |
| WO | WO 2014/191128 | A1 | 12/2014 |
| WO | WO 2014/191518 | A1 | 12/2014 |
| WO | WO 2014/191521 | A2 | 12/2014 |
| WO | WO 2014/191525 | A1 | 12/2014 |
| WO | WO 2014/191527 | A1 | 12/2014 |
| WO | WO 2014/193583 | A2 | 12/2014 |
| WO | WO 2014/194190 | A1 | 12/2014 |
| WO | WO 2014/197568 | A2 | 12/2014 |
| WO | WO 2014/197748 | A2 | 12/2014 |
| WO | WO 2014/199358 | A1 | 12/2014 |
| WO | WO 2014/200659 | A1 | 12/2014 |
| WO | WO 2014/201015 | A2 | 12/2014 |
| WO | WO 2014/204578 | A1 | 12/2014 |
| WO | WO 2014/204723 | A1 | 12/2014 |
| WO | WO 2014/204724 | A1 | 12/2014 |
| WO | WO 2014/204725 | A1 | 12/2014 |
| WO | WO 2014/204726 | A1 | 12/2014 |
| WO | WO 2014/204727 | A1 | 12/2014 |
| WO | WO 2014/204728 | A1 | 12/2014 |
| WO | WO 2014/204729 | A1 | 12/2014 |
| WO | WO 2014/205192 | A2 | 12/2014 |
| WO | WO 2014/207043 | A1 | 12/2014 |
| WO | WO 2015/002780 | A1 | 1/2015 |
| WO | WO 2015/004241 | A2 | 1/2015 |
| WO | WO 2015/006290 | A1 | 1/2015 |
| WO | WO 2015/006294 | A2 | 1/2015 |
| WO | WO 2015/006437 | A1 | 1/2015 |
| WO | WO 2015/006498 | A2 | 1/2015 |
| WO | WO 2015/006747 | A2 | 1/2015 |
| WO | WO 2015/007194 | A1 | 1/2015 |
| WO | WO 2015/010114 | A1 | 1/2015 |
| WO | WO 2015/011483 | A1 | 1/2015 |
| WO | WO 2015/013583 | A2 | 1/2015 |
| WO | WO 2015/017866 | A1 | 2/2015 |
| WO | WO 2015/018503 | A1 | 2/2015 |
| WO | WO 2015/021353 | A1 | 2/2015 |
| WO | WO 2015/021426 | A1 | 2/2015 |
| WO | WO 2015/021990 | A1 | 2/2015 |
| WO | WO 2015/024017 | A2 | 2/2015 |
| WO | WO 2015/024986 | A1 | 2/2015 |
| WO | WO 2015/026883 | A1 | 2/2015 |
| WO | WO 2015/026885 | A1 | 2/2015 |
| WO | WO 2015/026886 | A1 | 2/2015 |
| WO | WO 2015/026887 | A1 | 2/2015 |
| WO | WO 2015/027134 | A1 | 2/2015 |
| WO | WO 2015/028969 | A2 | 3/2015 |
| WO | WO 2015/030881 | A1 | 3/2015 |
| WO | WO 2015/031619 | A1 | 3/2015 |
| WO | WO 2015/031775 | A1 | 3/2015 |
| WO | WO 2015/032494 | A2 | 3/2015 |
| WO | WO 2015/033293 | A1 | 3/2015 |
| WO | WO 2015/034872 | A2 | 3/2015 |
| WO | WO 2015/034885 | A1 | 3/2015 |
| WO | WO 2015/035136 | A2 | 3/2015 |
| WO | WO 2015/035139 | A2 | 3/2015 |
| WO | WO 2015/035162 | A2 | 3/2015 |
| WO | WO 2015/040075 | A1 | 3/2015 |
| WO | WO 2015/040402 | A1 | 3/2015 |
| WO | WO 2015/042393 | A2 | 3/2015 |
| WO | WO 2015/042585 | A1 | 3/2015 |
| WO | WO 2015/048577 | A2 | 4/2015 |
| WO | WO 2015/048690 | A1 | 4/2015 |
| WO | WO 2015/048707 | A2 | 4/2015 |
| WO | WO 2015/048801 | A2 | 4/2015 |
| WO | WO 2015/049897 | A1 | 4/2015 |
| WO | WO 2015/051191 | A1 | 4/2015 |
| WO | WO 2015/052133 | A1 | 4/2015 |
| WO | WO 2015/052231 | A2 | 4/2015 |
| WO | WO 2015/052335 | A1 | 4/2015 |
| WO | WO 2015/053995 | A1 | 4/2015 |
| WO | WO 2015/054253 | A1 | 4/2015 |
| WO | WO 2015/054315 | A1 | 4/2015 |
| WO | WO 2015/057671 | A1 | 4/2015 |
| WO | WO 2015/057834 | A1 | 4/2015 |
| WO | WO 2015/057852 | A1 | 4/2015 |
| WO | WO 2015/057976 | A1 | 4/2015 |
| WO | WO 2015/057980 | A1 | 4/2015 |
| WO | WO 2015/059265 | A1 | 4/2015 |
| WO | WO 2015/065964 | A1 | 5/2015 |
| WO | WO 2015/066119 | A1 | 5/2015 |

(56) References Cited

FOREIGN PATENT DOCUMENTS

| | | | |
|---|---|---|---|
| WO | WO 2015/066634 | A2 | 5/2015 |
| WO | WO 2015/066636 | A2 | 5/2015 |
| WO | WO 2015/066637 | A1 | 5/2015 |
| WO | WO 2015/066638 | A2 | 5/2015 |
| WO | WO 2015/066643 | A1 | 5/2015 |
| WO | WO 2015/069682 | A2 | 5/2015 |
| WO | WO 2015/070083 | A1 | 5/2015 |
| WO | WO 2015/070193 | A1 | 5/2015 |
| WO | WO 2015/070212 | A1 | 5/2015 |
| WO | WO 2015/071474 | A2 | 5/2015 |
| WO | WO 2015/073683 | A2 | 5/2015 |
| WO | WO 2015/073867 | A1 | 5/2015 |
| WO | WO 2015/073990 | A1 | 5/2015 |
| WO | WO 2015/075056 | A1 | 5/2015 |
| WO | WO 2015/075154 | A2 | 5/2015 |
| WO | WO 2015/075175 | A1 | 5/2015 |
| WO | WO 2015/075195 | A1 | 5/2015 |
| WO | WO 2015/075557 | A2 | 5/2015 |
| WO | WO 2015/077058 | A2 | 5/2015 |
| WO | WO 2015/077290 | A2 | 5/2015 |
| WO | WO 2015/077318 | A1 | 5/2015 |
| WO | WO 2015/079056 | A1 | 6/2015 |
| WO | WO 2015/079057 | A2 | 6/2015 |
| WO | WO 2015/086795 | A1 | 6/2015 |
| WO | WO 2015/086798 | A2 | 6/2015 |
| WO | WO 2015/088643 | A1 | 6/2015 |
| WO | WO 2015/089046 | A1 | 6/2015 |
| WO | WO 2015/089077 | A2 | 6/2015 |
| WO | WO 2015/089277 | A1 | 6/2015 |
| WO | WO 2015/089351 | A1 | 6/2015 |
| WO | WO 2015/089354 | A1 | 6/2015 |
| WO | WO 2015/089364 | A1 | 6/2015 |
| WO | WO 2015/089406 | A1 | 6/2015 |
| WO | WO 2015/089419 | A2 | 6/2015 |
| WO | WO 2015/089427 | A1 | 6/2015 |
| WO | WO 2015/089462 | A1 | 6/2015 |
| WO | WO 2015/089465 | A1 | 6/2015 |
| WO | WO 2015/089473 | A1 | 6/2015 |
| WO | WO 2015/089486 | A2 | 6/2015 |
| WO | WO 2015/095804 | A1 | 6/2015 |
| WO | WO 2015/099850 | A1 | 7/2015 |
| WO | WO 2015/100929 | A1 | 7/2015 |
| WO | WO 2015/103057 | A1 | 7/2015 |
| WO | WO 2015/103153 | A1 | 7/2015 |
| WO | WO 2015/105928 | A1 | 7/2015 |
| WO | WO 2015/108993 | A1 | 7/2015 |
| WO | WO 2015/109752 | A1 | 7/2015 |
| WO | WO 2015/110474 | A1 | 7/2015 |
| WO | WO 2015/112790 | A2 | 7/2015 |
| WO | WO 2015/112896 | A2 | 7/2015 |
| WO | WO 2015/113063 | A1 | 7/2015 |
| WO | WO 2015/114365 | A1 | 8/2015 |
| WO | WO 2015/115903 | A1 | 8/2015 |
| WO | WO 2015/116686 | A1 | 8/2015 |
| WO | WO 2015/116969 | A2 | 8/2015 |
| WO | WO 2015/117021 | A1 | 8/2015 |
| WO | WO 2015/117041 | A1 | 8/2015 |
| WO | WO 2015/117081 | A2 | 8/2015 |
| WO | WO 2015/118156 | A1 | 8/2015 |
| WO | WO 2015/119941 | A2 | 8/2015 |
| WO | WO 2015/121454 | A1 | 8/2015 |
| WO | WO 2015/122967 | A1 | 8/2015 |
| WO | WO 2015/123339 | A1 | 8/2015 |
| WO | WO 2015/124715 | A1 | 8/2015 |
| WO | WO 2015/124718 | A1 | 8/2015 |
| WO | WO 2015/126927 | A2 | 8/2015 |
| WO | WO 2015/127428 | A1 | 8/2015 |
| WO | WO 2015/127439 | A1 | 8/2015 |
| WO | WO 2015/129686 | A1 | 9/2015 |
| WO | WO 2015/131101 | A1 | 9/2015 |
| WO | WO 2015/133554 | A1 | 9/2015 |
| WO | WO 2015/134121 | A2 | 9/2015 |
| WO | WO 2015/134812 | A1 | 9/2015 |
| WO | WO 2015/136001 | A1 | 9/2015 |
| WO | WO 2015/138510 | A1 | 9/2015 |
| WO | WO 2015/138739 | A2 | 9/2015 |
| WO | WO 2015/138855 | A1 | 9/2015 |
| WO | WO 2015/138870 | A2 | 9/2015 |
| WO | WO 2015/139008 | A1 | 9/2015 |
| WO | WO 2015/139139 | A1 | 9/2015 |
| WO | WO 2015/143046 | A2 | 9/2015 |
| WO | WO 2015/143177 | A1 | 9/2015 |
| WO | WO 2015/145417 | A1 | 10/2015 |
| WO | WO 2015/148431 | A1 | 10/2015 |
| WO | WO 2015/148670 | A1 | 10/2015 |
| WO | WO 2015/148680 | A1 | 10/2015 |
| WO | WO 2015/148761 | A1 | 10/2015 |
| WO | WO 2015/148860 | A1 | 10/2015 |
| WO | WO 2015/148863 | A2 | 10/2015 |
| WO | WO 2015/153760 | A2 | 10/2015 |
| WO | WO 2015/153780 | A1 | 10/2015 |
| WO | WO 2015/153789 | A1 | 10/2015 |
| WO | WO 2015/153791 | A1 | 10/2015 |
| WO | WO 2015/153889 | A2 | 10/2015 |
| WO | WO 2015/153940 | A1 | 10/2015 |
| WO | WO 2015/155341 | A1 | 10/2015 |
| WO | WO 2015/155686 | A2 | 10/2015 |
| WO | WO 2015/157070 | A2 | 10/2015 |
| WO | WO 2015/157534 | A1 | 10/2015 |
| WO | WO 2015/159068 | A1 | 10/2015 |
| WO | WO 2015/159086 | A1 | 10/2015 |
| WO | WO 2015/159087 | A1 | 10/2015 |
| WO | WO 2015/160683 | A1 | 10/2015 |
| WO | WO 2015/161276 | A2 | 10/2015 |
| WO | WO 2015/163733 | A1 | 10/2015 |
| WO | WO 2015/164740 | A1 | 10/2015 |
| WO | WO 2015/164748 | A1 | 10/2015 |
| WO | WO 2015/165274 | A1 | 11/2015 |
| WO | WO 2015/165275 | A1 | 11/2015 |
| WO | WO 2015/165276 | A1 | 11/2015 |
| WO | WO 2015/166272 | A2 | 11/2015 |
| WO | WO 2015/167766 | A1 | 11/2015 |
| WO | WO 2015/167956 | A1 | 11/2015 |
| WO | WO 2015/168125 | A1 | 11/2015 |
| WO | WO 2015/168158 | A1 | 11/2015 |
| WO | WO 2015/168404 | A1 | 11/2015 |
| WO | WO 2015/168547 | A2 | 11/2015 |
| WO | WO 2015/168800 | A1 | 11/2015 |
| WO | WO 2015/171603 | A1 | 11/2015 |
| WO | WO 2015/171894 | A1 | 11/2015 |
| WO | WO 2015/171932 | A1 | 11/2015 |
| WO | WO 2015/172128 | A1 | 11/2015 |
| WO | WO 2015/173436 | A1 | 11/2015 |
| WO | WO 2015/175642 | A2 | 11/2015 |
| WO | WO 2015/179540 | A1 | 11/2015 |
| WO | WO 2015/183025 | A1 | 12/2015 |
| WO | WO 2015/183026 | A1 | 12/2015 |
| WO | WO 2015/183885 | A1 | 12/2015 |
| WO | WO 2015/184259 | A1 | 12/2015 |
| WO | WO 2015/184262 | A1 | 12/2015 |
| WO | WO 2015/184268 | A1 | 12/2015 |
| WO | WO 2015/188056 | A1 | 12/2015 |
| WO | WO 2015/188065 | A1 | 12/2015 |
| WO | WO 2015/188094 | A1 | 12/2015 |
| WO | WO 2015/188109 | A1 | 12/2015 |
| WO | WO 2015/188132 | A1 | 12/2015 |
| WO | WO 2015/188135 | A1 | 12/2015 |
| WO | WO 2015/188191 | A1 | 12/2015 |
| WO | WO 2015/189693 | A1 | 12/2015 |
| WO | WO 2015/191693 | A2 | 12/2015 |
| WO | WO 2015/191899 | A1 | 12/2015 |
| WO | WO 2015/191911 | A2 | 12/2015 |
| WO | WO 2015/193858 | A1 | 12/2015 |
| WO | WO 2015/195547 | A1 | 12/2015 |
| WO | WO 2015/195621 | A1 | 12/2015 |
| WO | WO 2015/195798 | A1 | 12/2015 |
| WO | WO 2015/198020 | A1 | 12/2015 |
| WO | WO 2015/200334 | A1 | 12/2015 |
| WO | WO 2015/200378 | A1 | 12/2015 |
| WO | WO 2015/200555 | A2 | 12/2015 |
| WO | WO 2015/200805 | A2 | 12/2015 |
| WO | WO 2016/001978 | A1 | 1/2016 |
| WO | WO 2016/004010 | A1 | 1/2016 |
| WO | WO 2016/004318 | A1 | 1/2016 |

(56) References Cited

FOREIGN PATENT DOCUMENTS

| | | | |
|---|---|---|---|
| WO | WO 2016/005514 | A1 | 1/2016 |
| WO | WO 2016/007347 | A1 | 1/2016 |
| WO | WO 2016/007604 | A1 | 1/2016 |
| WO | WO 2016/007948 | A1 | 1/2016 |
| WO | WO 2016/011080 | A2 | 1/2016 |
| WO | WO 2016/011210 | A2 | 1/2016 |
| WO | WO 2016/011428 | A1 | 1/2016 |
| WO | WO 2016/012544 | A2 | 1/2016 |
| WO | WO 2016/012552 | A1 | 1/2016 |
| WO | WO 2016/014409 | A1 | 1/2016 |
| WO | WO 2016/014565 | A2 | 1/2016 |
| WO | WO 2016/014794 | A1 | 1/2016 |
| WO | WO 2016/014837 | A1 | 1/2016 |
| WO | WO 2016/016119 | A1 | 2/2016 |
| WO | WO 2016/016358 | A1 | 2/2016 |
| WO | WO 2016/019144 | A2 | 2/2016 |
| WO | WO 2016/020399 | A1 | 2/2016 |
| WO | WO 2016/021972 | A1 | 2/2016 |
| WO | WO 2016/021973 | A1 | 2/2016 |
| WO | WO 2016/022363 | A2 | 2/2016 |
| WO | WO 2016/022866 | A1 | 2/2016 |
| WO | WO 2016/022931 | A1 | 2/2016 |
| WO | WO 2016/025131 | A1 | 2/2016 |
| WO | WO 2016/025469 | A1 | 2/2016 |
| WO | WO 2016/025759 | A1 | 2/2016 |
| WO | WO 2016/026444 | A1 | 2/2016 |
| WO | WO 2016/028682 | A1 | 2/2016 |
| WO | WO 2016/028843 | A2 | 2/2016 |
| WO | WO 2016/028887 | A1 | 2/2016 |
| WO | WO 2016/033088 | A1 | 3/2016 |
| WO | WO 2016/033230 | A1 | 3/2016 |
| WO | WO 2016/033246 | A1 | 3/2016 |
| WO | WO 2016/033298 | A1 | 3/2016 |
| WO | WO 2016/035044 | A1 | 3/2016 |
| WO | WO 2016/035918 | A1 | 3/2016 |
| WO | WO 2016/036754 | A1 | 3/2016 |
| WO | WO 2016/037157 | A2 | 3/2016 |
| WO | WO 2016/040030 | A1 | 3/2016 |
| WO | WO 2016/040594 | A1 | 3/2016 |
| WO | WO 2016/044182 | A1 | 3/2016 |
| WO | WO 2016/044416 | A1 | 3/2016 |
| WO | WO 2016/046635 | A1 | 3/2016 |
| WO | WO 2016/049024 | A2 | 3/2016 |
| WO | WO 2016/049163 | A2 | 3/2016 |
| WO | WO 2016/049230 | A1 | 3/2016 |
| WO | WO 2016/049251 | A1 | 3/2016 |
| WO | WO 2016/049258 | A2 | 3/2016 |
| WO | WO 2016/053397 | A2 | 4/2016 |
| WO | WO 2016/054326 | A1 | 4/2016 |
| WO | WO 2016/057061 | A2 | 4/2016 |
| WO | WO 2016/057821 | A2 | 4/2016 |
| WO | WO 2016/057835 | A2 | 4/2016 |
| WO | WO 2016/057850 | A1 | 4/2016 |
| WO | WO 2016/057951 | A2 | 4/2016 |
| WO | WO 2016/057961 | A1 | 4/2016 |
| WO | WO 2016/061073 | A1 | 4/2016 |
| WO | WO 2016/061374 | A1 | 4/2016 |
| WO | WO 2016/061481 | A1 | 4/2016 |
| WO | WO 2016/061523 | A1 | 4/2016 |
| WO | WO 2016/064894 | A2 | 4/2016 |
| WO | WO 2016/065364 | A1 | 4/2016 |
| WO | WO 2016/069282 | A1 | 5/2016 |
| WO | WO 2016/069283 | A1 | 5/2016 |
| WO | WO 2016/069591 | A2 | 5/2016 |
| WO | WO 2016/069774 | A1 | 5/2016 |
| WO | WO 2016/069910 | A1 | 5/2016 |
| WO | WO 2016/069912 | A1 | 5/2016 |
| WO | WO 2016/070037 | A2 | 5/2016 |
| WO | WO 2016/070070 | A1 | 5/2016 |
| WO | WO 2016/070129 | A1 | 5/2016 |
| WO | WO 2016/072399 | A1 | 5/2016 |
| WO | WO 2016/072936 | A1 | 5/2016 |
| WO | WO 2016/073433 | A1 | 5/2016 |
| WO | WO 2016/073559 | A1 | 5/2016 |
| WO | WO 2016/073990 | A2 | 5/2016 |
| WO | WO 2016/075662 | A2 | 5/2016 |
| WO | WO 2016/076672 | A1 | 5/2016 |
| WO | WO 2016/077273 | A1 | 5/2016 |
| WO | WO 2016/077350 | A1 | 5/2016 |
| WO | WO 2016/080097 | A1 | 5/2016 |
| WO | WO 2016/080795 | A1 | 5/2016 |
| WO | WO 2016/081923 | A2 | 5/2016 |
| WO | WO 2016/081924 | A1 | 5/2016 |
| WO | WO 2016/082135 | A1 | 6/2016 |
| WO | WO 2016/083811 | A1 | 6/2016 |
| WO | WO 2016/084084 | A1 | 6/2016 |
| WO | WO 2016/084088 | A1 | 6/2016 |
| WO | WO 2016/086177 | A2 | 6/2016 |
| WO | WO 2016/089433 | A1 | 6/2016 |
| WO | WO 2016/089866 | A1 | 6/2016 |
| WO | WO 2016/089883 | A1 | 6/2016 |
| WO | WO 2016/090385 | A1 | 6/2016 |
| WO | WO 2016/094679 | A1 | 6/2016 |
| WO | WO 2016/094845 | A2 | 6/2016 |
| WO | WO 2016/094867 | A1 | 6/2016 |
| WO | WO 2016/094872 | A1 | 6/2016 |
| WO | WO 2016/094874 | A1 | 6/2016 |
| WO | WO 2016/094880 | A1 | 6/2016 |
| WO | WO 2016/094888 | A1 | 6/2016 |
| WO | WO 2016/097212 | A1 | 6/2016 |
| WO | WO 2016/097231 | A2 | 6/2016 |
| WO | WO 2016/097751 | A1 | 6/2016 |
| WO | WO 2016/099887 | A1 | 6/2016 |
| WO | WO 2016/100272 | A1 | 6/2016 |
| WO | WO 2016/100389 | A1 | 6/2016 |
| WO | WO 2016/100568 | A1 | 6/2016 |
| WO | WO 2016/100571 | A1 | 6/2016 |
| WO | WO 2016/100951 | A2 | 6/2016 |
| WO | WO 2016/100955 | A2 | 6/2016 |
| WO | WO 2016/100974 | A1 | 6/2016 |
| WO | WO 2016/103233 | A2 | 6/2016 |
| WO | WO 2016/104716 | A1 | 6/2016 |
| WO | WO 2016/106236 | A1 | 6/2016 |
| WO | WO 2016/106239 | A1 | 6/2016 |
| WO | WO 2016/106244 | A1 | 6/2016 |
| WO | WO 2016/106338 | A2 | 6/2016 |
| WO | WO 2016/108926 | A1 | 7/2016 |
| WO | WO 2016/109255 | A1 | 7/2016 |
| WO | WO 2016/109840 | A2 | 7/2016 |
| WO | WO 2016/110214 | A1 | 7/2016 |
| WO | WO 2016/110453 | A1 | 7/2016 |
| WO | WO 2016/110511 | A1 | 7/2016 |
| WO | WO 2016/110512 | A1 | 7/2016 |
| WO | WO 2016/111546 | A2 | 7/2016 |
| WO | WO 2016/112242 | A1 | 7/2016 |
| WO | WO 2016/112351 | A1 | 7/2016 |
| WO | WO 2016/112963 | A1 | 7/2016 |
| WO | WO 2016/113357 | A1 | 7/2016 |
| WO | WO 2016/114972 | A1 | 7/2016 |
| WO | WO 2016/115179 | A1 | 7/2016 |
| WO | WO 2016/115326 | A1 | 7/2016 |
| WO | WO 2016/115355 | A1 | 7/2016 |
| WO | WO 2016/116032 | A1 | 7/2016 |
| WO | WO 2016/120480 | A1 | 8/2016 |
| WO | WO 2016/123071 | A1 | 8/2016 |
| WO | WO 2016/123230 | A1 | 8/2016 |
| WO | WO 2016/123243 | A1 | 8/2016 |
| WO | WO 2016/123578 | A1 | 8/2016 |
| WO | WO 2016/126747 | A1 | 8/2016 |
| WO | WO 2016/130600 | A2 | 8/2016 |
| WO | WO 2016/130697 | A1 | 8/2016 |
| WO | WO 2016/131009 | A1 | 8/2016 |
| WO | WO 2016/132122 | A1 | 8/2016 |
| WO | WO 2016/133165 | A1 | 8/2016 |
| WO | WO 2016/135507 | A1 | 9/2016 |
| WO | WO 2016/135557 | A2 | 9/2016 |
| WO | WO 2016/135558 | A2 | 9/2016 |
| WO | WO 2016/135559 | A2 | 9/2016 |
| WO | WO 2016/137774 | A1 | 9/2016 |
| WO | WO 2016/137949 | A1 | 9/2016 |
| WO | WO 2016/141224 | A1 | 9/2016 |
| WO | WO 2016/141893 | A1 | 9/2016 |
| WO | WO 2016/142719 | A1 | 9/2016 |
| WO | WO 2016/145150 | A2 | 9/2016 |

(56) References Cited

FOREIGN PATENT DOCUMENTS

| | | | |
|---|---|---|---|
| WO | WO 2016/148994 | A1 | 9/2016 |
| WO | WO 2016/149484 | A2 | 9/2016 |
| WO | WO 2016/149547 | A1 | 9/2016 |
| WO | WO 2016/150336 | A1 | 9/2016 |
| WO | WO 2016/150855 | A1 | 9/2016 |
| WO | WO 2016/154016 | A2 | 9/2016 |
| WO | WO 2016/154579 | A2 | 9/2016 |
| WO | WO 2016/154596 | A1 | 9/2016 |
| WO | WO 2016/155482 | A1 | 10/2016 |
| WO | WO 2016/161004 | A1 | 10/2016 |
| WO | WO 2016/161207 | A1 | 10/2016 |
| WO | WO 2016/161260 | A1 | 10/2016 |
| WO | WO 2016/161380 | A1 | 10/2016 |
| WO | WO 2016/161446 | A1 | 10/2016 |
| WO | WO 2016/164305 | A1 | 10/2016 |
| WO | WO 2016/164356 | A1 | 10/2016 |
| WO | WO 2016/164797 | A1 | 10/2016 |
| WO | WO 2016/166340 | A1 | 10/2016 |
| WO | WO 2016/167300 | A1 | 10/2016 |
| WO | WO 2016/168631 | A1 | 10/2016 |
| WO | WO 2016/170484 | A1 | 10/2016 |
| WO | WO 2016/172359 | A2 | 10/2016 |
| WO | WO 2016/172727 | A1 | 10/2016 |
| WO | WO 2016/174056 | A1 | 11/2016 |
| WO | WO 2016/174151 | A1 | 11/2016 |
| WO | WO 2016/174250 | A1 | 11/2016 |
| WO | WO 2016/176191 | A1 | 11/2016 |
| WO | WO 2016/176404 | A1 | 11/2016 |
| WO | WO 2016/176690 | A2 | 11/2016 |
| WO | WO 2016/177682 | A1 | 11/2016 |
| WO | WO 2016/178207 | A1 | 11/2016 |
| WO | WO 2016/179038 | A1 | 11/2016 |
| WO | WO 2016/179112 | A1 | 11/2016 |
| WO | WO 2016/181357 | A1 | 11/2016 |
| WO | WO 2016/182893 | A1 | 11/2016 |
| WO | WO 2016/182917 | A1 | 11/2016 |
| WO | WO 2016/182959 | A1 | 11/2016 |
| WO | WO 2016/183236 | A1 | 11/2016 |
| WO | WO 2016/183298 | A2 | 11/2016 |
| WO | WO 2016/183345 | A1 | 11/2016 |
| WO | WO 2016/183402 | A2 | 11/2016 |
| WO | WO 2016/183438 | A1 | 11/2016 |
| WO | WO 2016/183448 | A1 | 11/2016 |
| WO | WO 2016/184955 | A2 | 11/2016 |
| WO | WO 2016/184989 | A1 | 11/2016 |
| WO | WO 2016/185411 | A1 | 11/2016 |
| WO | WO 2016/186745 | A1 | 11/2016 |
| WO | WO 2016/186772 | A2 | 11/2016 |
| WO | WO 2016/186946 | A1 | 11/2016 |
| WO | WO 2016/186953 | A1 | 11/2016 |
| WO | WO 2016/187717 | A1 | 12/2016 |
| WO | WO 2016/187904 | A1 | 12/2016 |
| WO | WO 2016/191684 | A1 | 12/2016 |
| WO | WO 2016/191869 | A1 | 12/2016 |
| WO | WO 2016/196273 | A1 | 12/2016 |
| WO | WO 2016/196282 | A1 | 12/2016 |
| WO | WO 2016/196308 | A1 | 12/2016 |
| WO | WO 2016/196361 | A1 | 12/2016 |
| WO | WO 2016/196499 | A1 | 12/2016 |
| WO | WO 2016/196539 | A2 | 12/2016 |
| WO | WO 2016/196655 | A1 | 12/2016 |
| WO | WO 2016/196805 | A1 | 12/2016 |
| WO | WO 2016/196887 | A1 | 12/2016 |
| WO | WO 2016/197132 | A1 | 12/2016 |
| WO | WO 2016/197133 | A1 | 12/2016 |
| WO | WO 2016/197354 | A1 | 12/2016 |
| WO | WO 2016/197355 | A1 | 12/2016 |
| WO | WO 2016/197356 | A1 | 12/2016 |
| WO | WO 2016/197357 | A1 | 12/2016 |
| WO | WO 2016/197358 | A1 | 12/2016 |
| WO | WO 2016/197359 | A1 | 12/2016 |
| WO | WO 2016/197360 | A1 | 12/2016 |
| WO | WO 2016/197361 | A1 | 12/2016 |
| WO | WO 2016/197362 | A1 | 12/2016 |
| WO | WO 2016/198361 | A1 | 12/2016 |
| WO | WO 2016/198500 | A1 | 12/2016 |
| WO | WO 2016/200263 | A1 | 12/2016 |
| WO | WO 2016/201047 | A1 | 12/2016 |
| WO | WO 2016/201138 | A1 | 12/2016 |
| WO | WO 2016/201152 | A1 | 12/2016 |
| WO | WO 2016/201153 | A1 | 12/2016 |
| WO | WO 2016/201155 | A1 | 12/2016 |
| WO | WO 2016/205276 | A1 | 12/2016 |
| WO | WO 2016/205613 | A1 | 12/2016 |
| WO | WO 2016/205623 | A1 | 12/2016 |
| WO | WO 2016/205680 | A1 | 12/2016 |
| WO | WO 2016/205688 | A2 | 12/2016 |
| WO | WO 2016/205703 | A1 | 12/2016 |
| WO | WO 2016/205711 | A1 | 12/2016 |
| WO | WO 2016/205728 | A1 | 12/2016 |
| WO | WO 2016/205745 | A2 | 12/2016 |
| WO | WO 2016/205749 | A1 | 12/2016 |
| WO | WO 2016/205759 | A1 | 12/2016 |
| WO | WO 2016/205764 | A1 | 12/2016 |
| WO | WO 2017/001572 | A1 | 1/2017 |
| WO | WO 2017/001988 | A1 | 1/2017 |
| WO | WO 2017/004261 | A1 | 1/2017 |
| WO | WO 2017/004279 | A2 | 1/2017 |
| WO | WO 2017/004616 | A1 | 1/2017 |
| WO | WO 2017/005807 | A1 | 1/2017 |
| WO | WO 2017/009399 | A1 | 1/2017 |
| WO | WO 2017/010556 | A1 | 1/2017 |
| WO | WO 2017/011519 | A1 | 1/2017 |
| WO | WO 2017/011721 | A1 | 1/2017 |
| WO | WO 2017/011804 | A1 | 1/2017 |
| WO | WO 2017/015015 | A1 | 1/2017 |
| WO | WO 2017/015101 | A1 | 1/2017 |
| WO | WO 2017/015545 | A1 | 1/2017 |
| WO | WO 2017/015567 | A1 | 1/2017 |
| WO | WO 2017/015637 | A1 | 1/2017 |
| WO | WO 2017/017016 | A1 | 2/2017 |
| WO | WO 2017/019867 | A1 | 2/2017 |
| WO | WO 2017/019895 | A1 | 2/2017 |
| WO | WO 2017/023803 | A1 | 2/2017 |
| WO | WO 2017/023974 | A1 | 2/2017 |
| WO | WO 2017/024047 | A1 | 2/2017 |
| WO | WO 2017/024319 | A1 | 2/2017 |
| WO | WO 2017/024343 | A1 | 2/2017 |
| WO | WO 2017/024602 | A1 | 2/2017 |
| WO | WO 2017/025323 | A1 | 2/2017 |
| WO | WO 2017/027423 | A1 | 2/2017 |
| WO | WO 2017/028768 | A1 | 2/2017 |
| WO | WO 2017/029664 | A1 | 2/2017 |
| WO | WO 2017/031360 | A1 | 2/2017 |
| WO | WO 2017/031483 | A1 | 2/2017 |
| WO | WO 2017/035416 | A2 | 3/2017 |
| WO | WO 2017/040348 | A1 | 3/2017 |
| WO | WO 2017/040511 | A1 | 3/2017 |
| WO | WO 2017/040709 | A1 | 3/2017 |
| WO | WO 2017/040786 | A1 | 3/2017 |
| WO | WO 2017/040793 | A1 | 3/2017 |
| WO | WO 2017/040813 | A2 | 3/2017 |
| WO | WO 2017/043573 | A1 | 3/2017 |
| WO | WO 2017/043656 | A1 | 3/2017 |
| WO | WO 2017/044419 | A1 | 3/2017 |
| WO | WO 2017/044776 | A1 | 3/2017 |
| WO | WO 2017/044857 | A2 | 3/2017 |
| WO | WO 2017/048390 | A1 | 3/2017 |
| WO | WO 2017/049129 | A2 | 3/2017 |
| WO | WO 2017/050963 | A1 | 3/2017 |
| WO | WO 2017/053312 | A1 | 3/2017 |
| WO | WO 2017/053431 | A2 | 3/2017 |
| WO | WO 2017/053713 | A1 | 3/2017 |
| WO | WO 2017/053729 | A1 | 3/2017 |
| WO | WO 2017/053753 | A1 | 3/2017 |
| WO | WO 2017/053762 | A1 | 3/2017 |
| WO | WO 2017/053879 | A1 | 3/2017 |
| WO | WO 2017/054721 | A1 | 4/2017 |
| WO | WO 2017/058658 | A2 | 4/2017 |
| WO | WO 2017/059241 | A1 | 4/2017 |
| WO | WO 2017/062605 | A1 | 4/2017 |
| WO | WO 2017/062723 | A1 | 4/2017 |
| WO | WO 2017/062754 | A1 | 4/2017 |
| WO | WO 2017/062855 | A1 | 4/2017 |

(56) References Cited

FOREIGN PATENT DOCUMENTS

| | | | |
|---|---|---|---|
| WO | WO 2017/062886 | A1 | 4/2017 |
| WO | WO 2017/062983 | A1 | 4/2017 |
| WO | WO 2017/064439 | A1 | 4/2017 |
| WO | WO 2017/064546 | A1 | 4/2017 |
| WO | WO 2017/064566 | A2 | 4/2017 |
| WO | WO 2017/066175 | A1 | 4/2017 |
| WO | WO 2017/066497 | A2 | 4/2017 |
| WO | WO 2017/066588 | A2 | 4/2017 |
| WO | WO 2017/066707 | A1 | 4/2017 |
| WO | WO 2017/066781 | A1 | 4/2017 |
| WO | WO 2017/068077 | A1 | 4/2017 |
| WO | WO 2017/068377 | A1 | 4/2017 |
| WO | WO 2017/069829 | A2 | 4/2017 |
| WO | WO 2017/070029 | A1 | 4/2017 |
| WO | WO 2017/070032 | A1 | 4/2017 |
| WO | WO 2017/070169 | A1 | 4/2017 |
| WO | WO 2017/070284 | A1 | 4/2017 |
| WO | WO 2017/070598 | A1 | 4/2017 |
| WO | WO 2017/070605 | A1 | 4/2017 |
| WO | WO 2017/070632 | A2 | 4/2017 |
| WO | WO 2017/070633 | A2 | 4/2017 |
| WO | WO 2017/072590 | A1 | 5/2017 |
| WO | WO 2017/074526 | A1 | 5/2017 |
| WO | WO 2017/074962 | A1 | 5/2017 |
| WO | WO 2017/075261 | A1 | 5/2017 |
| WO | WO 2017/075335 | A1 | 5/2017 |
| WO | WO 2017/075475 | A1 | 5/2017 |
| WO | WO 2017/077135 | A1 | 5/2017 |
| WO | WO 2017/077329 | A2 | 5/2017 |
| WO | WO 2017/078751 | A1 | 5/2017 |
| WO | WO 2017/079400 | A1 | 5/2017 |
| WO | WO 2017/079428 | A1 | 5/2017 |
| WO | WO 2017/079673 | A1 | 5/2017 |
| WO | WO 2017/079724 | A1 | 5/2017 |
| WO | WO 2017/081097 | A1 | 5/2017 |
| WO | WO 2017/081288 | A1 | 5/2017 |
| WO | WO 2017/083368 | A1 | 5/2017 |
| WO | WO 2017/083722 | A1 | 5/2017 |
| WO | WO 2017/083766 | A1 | 5/2017 |
| WO | WO 2017/087395 | A1 | 5/2017 |
| WO | WO 2017/090724 | A1 | 6/2017 |
| WO | WO 2017/091510 | A1 | 6/2017 |
| WO | WO 2017/091630 | A1 | 6/2017 |
| WO | WO 2017/092201 | A1 | 6/2017 |
| WO | WO 2017/093370 | A1 | 6/2017 |
| WO | WO 2017/093969 | A1 | 6/2017 |
| WO | WO 2017/095111 | A1 | 6/2017 |
| WO | WO 2017/096041 | A1 | 6/2017 |
| WO | WO 2017/096237 | A1 | 6/2017 |
| WO | WO 2017/100158 | A1 | 6/2017 |
| WO | WO 2017/100431 | A2 | 6/2017 |
| WO | WO 2017/104404 | A1 | 6/2017 |
| WO | WO 2017/105251 | A1 | 6/2017 |
| WO | WO 2017/105350 | A1 | 6/2017 |
| WO | WO 2017/105991 | A1 | 6/2017 |
| WO | WO 2017/106414 | A1 | 6/2017 |
| WO | WO 2017/106528 | A2 | 6/2017 |
| WO | WO 2017/106537 | A2 | 6/2017 |
| WO | WO 2017/106569 | A1 | 6/2017 |
| WO | WO 2017/106616 | A1 | 6/2017 |
| WO | WO 2017/106657 | A1 | 6/2017 |
| WO | WO 2017/106767 | A1 | 6/2017 |
| WO | WO 2017/109134 | A1 | 6/2017 |
| WO | WO 2017/109757 | A1 | 6/2017 |
| WO | WO 2017/112620 | A1 | 6/2017 |
| WO | WO 2017/115268 | A1 | 7/2017 |
| WO | WO 2017/117395 | A1 | 7/2017 |
| WO | WO 2017/118598 | A1 | 7/2017 |
| WO | WO 2017/118720 | A1 | 7/2017 |
| WO | WO 2017/123609 | A1 | 7/2017 |
| WO | WO 2017/123910 | A1 | 7/2017 |
| WO | WO 2017/124086 | A1 | 7/2017 |
| WO | WO 2017/124100 | A1 | 7/2017 |
| WO | WO 2017/124652 | A1 | 7/2017 |
| WO | WO 2017/126987 | A1 | 7/2017 |
| WO | WO 2017/127807 | A1 | 7/2017 |
| WO | WO 2017/131237 | A1 | 8/2017 |
| WO | WO 2017/132112 | A1 | 8/2017 |
| WO | WO 2017/132580 | A2 | 8/2017 |
| WO | WO 2017/136520 | A1 | 8/2017 |
| WO | WO 2017/136629 | A1 | 8/2017 |
| WO | WO 2017/136794 | A1 | 8/2017 |
| WO | WO 2017/139264 | A1 | 8/2017 |
| WO | WO 2017/139505 | A2 | 8/2017 |
| WO | WO 2017/141173 | A2 | 8/2017 |
| WO | WO 2017/142835 | A1 | 8/2017 |
| WO | WO 2017/142923 | A1 | 8/2017 |
| WO | WO 2017/142999 | A2 | 8/2017 |
| WO | WO 2017/143042 | A2 | 8/2017 |
| WO | WO 2017/147056 | A1 | 8/2017 |
| WO | WO 2017/147278 | A1 | 8/2017 |
| WO | WO 2017/147432 | A1 | 8/2017 |
| WO | WO 2017/147446 | A1 | 8/2017 |
| WO | WO 2017/147555 | A1 | 8/2017 |
| WO | WO 2017/151444 | A1 | 9/2017 |
| WO | WO 2017/151719 | A1 | 9/2017 |
| WO | WO 2017/152015 | A1 | 9/2017 |
| WO | WO 2017/155717 | A1 | 9/2017 |
| WO | WO 2017/157422 | A1 | 9/2017 |
| WO | WO 2017/158153 | A1 | 9/2017 |
| WO | WO 2017/160689 | A1 | 9/2017 |
| WO | WO 2017/160752 | A1 | 9/2017 |
| WO | WO 2017/160890 | A1 | 9/2017 |
| WO | WO 2017/161068 | A1 | 9/2017 |
| WO | WO 2017/165741 | A1 | 9/2017 |
| WO | WO 2017/165826 | A1 | 9/2017 |
| WO | WO 2017/165862 | A1 | 9/2017 |
| WO | WO 2017/167712 | A1 | 10/2017 |
| WO | WO 2017/172644 | A2 | 10/2017 |
| WO | WO 2017/172645 | A2 | 10/2017 |
| WO | WO 2017/172860 | A1 | 10/2017 |
| WO | WO 2017/173004 | A1 | 10/2017 |
| WO | WO 2017/173054 | A1 | 10/2017 |
| WO | WO 2017/173092 | A1 | 10/2017 |
| WO | WO 2017/174329 | A1 | 10/2017 |
| WO | WO 2017/176529 | A1 | 10/2017 |
| WO | WO 2017/176806 | A1 | 10/2017 |
| WO | WO 2017/178590 | A1 | 10/2017 |
| WO | WO 2017/180694 | A1 | 10/2017 |
| WO | WO 2017/180711 | A1 | 10/2017 |
| WO | WO 2017/180915 | A2 | 10/2017 |
| WO | WO 2017/180926 | A1 | 10/2017 |
| WO | WO 2017/181107 | A2 | 10/2017 |
| WO | WO 2017/181735 | A2 | 10/2017 |
| WO | WO 2017/182468 | A1 | 10/2017 |
| WO | WO 2017/182585 | A1 | 10/2017 |
| WO | WO 2017/182607 | A1 | 10/2017 |
| WO | WO 2017/184334 | A1 | 10/2017 |
| WO | WO 2017/184768 | A1 | 10/2017 |
| WO | WO 2017/184786 | A1 | 10/2017 |
| WO | WO 2017/186550 | A1 | 11/2017 |
| WO | WO 2017/189308 | A1 | 11/2017 |
| WO | WO 2017/189336 | A1 | 11/2017 |
| WO | WO 2017/190041 | A1 | 11/2017 |
| WO | WO 2017/190257 | A1 | 11/2017 |
| WO | WO 2017/190664 | A1 | 11/2017 |
| WO | WO 2017/191210 | A1 | 11/2017 |
| WO | WO 2017/191274 | A2 | 11/2017 |
| WO | WO 2017/192172 | A1 | 11/2017 |
| WO | WO 2017/192512 | A2 | 11/2017 |
| WO | WO 2017/192544 | A1 | 11/2017 |
| WO | WO 2017/192573 | A1 | 11/2017 |
| WO | WO 2017/193029 | A2 | 11/2017 |
| WO | WO 2017/193053 | A1 | 11/2017 |
| WO | WO 2017/196768 | A1 | 11/2017 |
| WO | WO 2017/197038 | A1 | 11/2017 |
| WO | WO 2017/197238 | A1 | 11/2017 |
| WO | WO 2017/197301 | A1 | 11/2017 |
| WO | WO 2017/201476 | A1 | 11/2017 |
| WO | WO 2017/205290 | A1 | 11/2017 |
| WO | WO 2017/205423 | A1 | 11/2017 |
| WO | WO 2017/207589 | A1 | 12/2017 |
| WO | WO 2017/208247 | A1 | 12/2017 |
| WO | WO 2017/209809 | A1 | 12/2017 |

(56) References Cited

FOREIGN PATENT DOCUMENTS

WO WO 2017/213896 A1 12/2017
WO WO 2017/213898 A2 12/2017
WO WO 2017/214460 A1 12/2017
WO WO 2017/216392 A1 12/2017
WO WO 2017/216771 A2 12/2017
WO WO 2017/218185 A1 12/2017
WO WO 2017/219027 A1 12/2017
WO WO 2017/219033 A1 12/2017
WO WO 2017/220751 A1 12/2017
WO WO 2017/222370 A1 12/2017
WO WO 2017/222773 A1 12/2017
WO WO 2017/222834 A1 12/2017
WO WO 2017/223107 A1 12/2017
WO WO 2017/223330 A1 12/2017
WO WO 2018/000657 A1 1/2018
WO WO 2018/002719 A1 1/2018
WO WO 2018/005117 A1 1/2018
WO WO 2018/005289 A2 1/2018
WO WO 2018/005691 A1 1/2018
WO WO 2018/005782 A1 1/2018
WO WO 2018/005873 A1 1/2018
WO WO 2018/06693 A1 1/2018
WO WO 2018/009520 A1 1/2018
WO WO 2018/009562 A1 1/2018
WO WO 2018/009822 A1 1/2018
WO WO 2018/013821 A1 1/2018
WO WO 2018/013932 A1 1/2018
WO WO 2018/013990 A1 1/2018
WO WO 2018/014384 A1 1/2018
WO WO 2018/015444 A1 1/2018
WO WO 2018/015936 A2 1/2018
WO WO 2018/017754 A1 1/2018
WO WO 2018/018979 A1 2/2018
WO WO 2018/020248 A1 2/2018
WO WO 2018/021878 A1 2/2018
WO WO 2018/022480 A1 2/2018
WO WO 2018/022634 A1 2/2018
WO WO 2018/025206 A1 2/2018
WO WO 2018/026723 A1 2/2018
WO WO 2018/026976 A1 2/2018
WO WO 2018/027078 A1 2/2018
WO WO 2018/030608 A1 2/2018
WO WO 2018/031683 A1 2/2018
WO WO 2018/035250 A1 2/2018
WO WO 2018/035300 A1 2/2018
WO WO 2018/035423 A1 2/2018
WO WO 2018/035503 A1 2/2018
WO WO 2018/039145 A1 3/2018
WO WO 2018/039438 A1 3/2018
WO WO 2018/039440 A1 3/2018
WO WO 2018/039448 A1 3/2018
WO WO 2018/045630 A1 3/2018
WO WO 2018/048827 A1 3/2018
WO WO 2018/049073 A1 3/2018
WO WO 2018/049168 A1 3/2018
WO WO 2018/051347 A1 3/2018
WO WO 2018/058064 A1 3/2018
WO WO 2018/062866 A2 4/2018
WO WO 2018/064352 A1 4/2018
WO WO 2018/064371 A1 4/2018
WO WO 2018/064516 A1 4/2018
WO WO 2018/067546 A1 4/2018
WO WO 2018/067846 A1 4/2018
WO WO 2018/068053 A2 4/2018
WO WO 2018/069474 A1 4/2018
WO WO 2018/071623 A2 4/2018
WO WO 2018/071663 A1 4/2018
WO WO 2018/071868 A1 4/2018
WO WO 2018/071892 A1 4/2018
WO WO 2018/074979 A1 4/2018
WO WO 2018/079134 A1 5/2018
WO WO 2018/080573 A1 5/2018
WO WO 2018/081504 A1 5/2018
WO WO 2018/081535 A2 5/2018
WO WO 2018/081728 A1 5/2018
WO WO 2018/083128 A2 5/2018
WO WO 2018/083606 A1 5/2018
WO WO 2018/085288 A1 5/2018
WO WO 2018/085414 A1 5/2018
WO WO 2018/085842 A1 5/2018
WO WO 2018/086623 A1 5/2018
WO WO 2018/089664 A1 5/2018
WO WO 2018/093990 A1 5/2018
WO WO 2018/098383 A1 5/2018
WO WO 2018/098480 A1 5/2018
WO WO 2018/098587 A1 6/2018
WO WO 2018/099256 A1 6/2018
WO WO 2018/103686 A1 6/2018
WO WO 2018/106268 A1 6/2018
WO WO 2018/107028 A1 6/2018
WO WO 2018/107103 A1 6/2018
WO WO 2018/107129 A1 6/2018
WO WO 2018/108272 A1 6/2018
WO WO 2018/109101 A1 6/2018
WO WO 2018/111946 A1 6/2018
WO WO 2018/111947 A1 6/2018
WO WO 2018/112336 A1 6/2018
WO WO 2018/112446 A2 6/2018
WO WO 2018/119354 A1 6/2018
WO WO 2018/119359 A1 6/2018
WO WO 2018/120283 A1 7/2018
WO WO 2018/130830 A1 7/2018
WO WO 2018/135838 A2 7/2018
WO WO 2018/136396 A2 7/2018
WO WO 2018/138385 A1 8/2018
WO WO 2018/142364 A1 8/2018
WO WO 2018/148246 A1 8/2018
WO WO 2018/148256 A1 8/2018
WO WO 2018/148647 A2 8/2018
WO WO 2018/149418 A1 8/2018
WO WO 2018/149888 A1 8/2018
WO WO 2018/149915 A1 8/2018
WO WO 2018/152197 A1 8/2018
WO WO 2018/152418 A1 8/2018
WO WO 2018/154380 A1 8/2018
WO WO 2018/154387 A1 8/2018
WO WO 2018/154412 A1 8/2018
WO WO 2018/154413 A1 8/2018
WO WO 2018/154418 A1 8/2018
WO WO 2018/154439 A1 8/2018
WO WO 2018/154459 A1 8/2018
WO WO 2018/154462 A2 8/2018
WO WO 2018/156372 A1 8/2018
WO WO 2018/156824 A1 8/2018
WO WO 2018/161009 A1 9/2018
WO WO 2018/161032 A1 9/2018
WO WO 2018/165504 A1 9/2018
WO WO 2018/165629 A1 9/2018
WO WO 2018/170015 A1 9/2018
WO WO 2018/170340 A1 9/2018
WO WO 2018/175502 A2 9/2018
WO WO 2018/176009 A1 9/2018
WO WO 2018/177351 A1 10/2018
WO WO 2018/179578 A1 10/2018
WO WO 2018/183403 A1 10/2018
WO WO 2018/189184 A1 10/2018
WO WO 2018/191388 A1 10/2018
WO WO 2018/195402 A1 10/2018
WO WO 2018/195545 A2 10/2018
WO WO 2018/195555 A1 10/2018
WO WO 2018/197020 A1 11/2018
WO WO 2018/197495 A1 11/2018
WO WO 2018/200597 A1 11/2018
WO WO 2018/202800 A1 11/2018
WO WO 2018/204493 A1 11/2018
WO WO 2018/208755 A1 11/2018
WO WO 2018/208998 A1 11/2018
WO WO 2018/209158 A2 11/2018
WO WO 2018/209320 A1 11/2018
WO WO 2018/213351 A1 11/2018
WO WO 2018/213708 A1 11/2018
WO WO 2018/213726 A1 11/2018
WO WO 2018/213771 A1 11/2018
WO WO 2018/213791 A1 11/2018

(56) References Cited

FOREIGN PATENT DOCUMENTS

WO WO 2018/217852 A1 11/2018
WO WO 2018/217981 A1 11/2018
WO WO 2018/218188 A2 11/2018
WO WO 2018/218206 A1 11/2018
WO WO-2018218166 A1 * 11/2018 ............ C12N 15/90
WO WO 2018/226855 A1 12/2018
WO WO 2019/005884 A1 1/2019
WO WO 2019/005886 A1 1/2019
WO WO 2019/010384 A1 1/2019
WO WO 2019/023680 A1 1/2019
WO WO 2019/042284 A1 3/2019
WO WO 2019/051097 A1 3/2019
WO WO 2019/067992 A1 4/2019
WO WO 2019/075357 A1 4/2019
WO WO 2019/079347 A1 4/2019
WO WO 2019/084062 A1 5/2019
WO WO 2019/090169 A1 5/2019
WO WO 2019/090367 A1 5/2019
WO WO 2019/092042 A1 5/2019
WO WO 2019/118497 A1 6/2019
WO WO 2019/118935 A1 6/2019
WO WO 2019/118949 A1 6/2019
WO WO 2019/123429 A1 6/2019
WO WO 2019/123430 A1 6/2019
WO WO 2019/126709 A1 6/2019
WO WO 2019/139645 A2 7/2019
WO WO 2019/139951 A1 7/2019
WO WO 2019/147014 A1 8/2019
WO WO 2019/161251 A1 8/2019
WO WO 2019/168953 A1 9/2019
WO WO 2019/183641 A1 9/2019
WO WO 2019/204369 A1 10/2019
WO 2019/213257 A1 11/2019
WO WO 2019/217942 A1 11/2019
WO WO 2019/217943 A1 11/2019
WO WO 2019/226593 A1 11/2019
WO WO 2019/226953 A1 11/2019
WO WO 2019/236566 A1 12/2019
WO WO 2019/241649 A1 12/2019
WO WO 2020/014261 A1 1/2020
WO WO 2020/028555 A2 2/2020
WO WO 2020/028823 A1 2/2020
WO WO 2020/041751 A1 2/2020
WO WO 2020/047124 A1 3/2020
WO WO 2020/051360 A1 3/2020
WO WO 2020/081568 A1 4/2020
WO WO 2020/086908 A1 4/2020
WO WO 2020/092453 A1 5/2020
WO WO 2020/102369 A1 5/2020
WO WO 2020/102659 A1 5/2020
WO WO 2020/102709 A1 5/2020
WO WO 2020/154500 A1 7/2020
WO WO 2020/157008 A1 8/2020
WO WO 2020/160071 A1 8/2020
WO WO 2020/160418 A1 8/2020
WO WO 2020/160481 A1 8/2020
WO WO 2020/160517 A1 8/2020
WO WO 2020/180975 A1 9/2020
WO WO 2020/181178 A1 9/2020
WO WO 2020/181180 A1 9/2020
WO WO 2020/181193 A1 9/2020
WO WO 2020/181195 A1 9/2020
WO WO 2020/181202 A1 9/2020
WO WO 2020/191153 A2 9/2020
WO WO 2020/191171 A1 9/2020
WO WO 2020/191233 A1 9/2020
WO WO 2020/191234 A1 9/2020
WO WO 2020/191239 A1 9/2020
WO WO 2020/191241 A1 9/2020
WO WO 2020/191242 A1 9/2020
WO WO 2020/191243 A1 9/2020
WO WO 2020/191245 A1 9/2020
WO WO 2020/191246 A1 9/2020
WO WO 2020/191248 A1 9/2020
WO WO 2020/191249 A1 9/2020
WO WO 2020/193696 A1 10/2020
WO WO 2020/205681 A1 10/2020
WO WO 2020/210751 A1 10/2020
WO WO 2020/214842 A1 10/2020
WO WO 2020/225287 A1 11/2020
WO WO 2020/236982 A1 11/2020
WO WO 2020/247587 A1 12/2020
WO WO 2020/247803 A2 12/2020
WO WO 2021/022043 A2 2/2021
WO WO 2021/025750 A1 2/2021
WO WO 2021/030344 A1 2/2021
WO WO 2021/030666 A1 2/2021
WO WO 2021/042047 A1 3/2021
WO WO 2021/042062 A2 3/2021
WO WO 2021/046143 A1 3/2021
WO WO 2021/072328 A1 4/2021
WO WO 2021/080922 A1 4/2021
WO WO 2021/081264 A1 4/2021
WO WO 2021/087182 A1 5/2021
WO WO 2021/087401 A1 5/2021
WO WO 2021/108717 A2 6/2021
WO WO 2021/113772 A1 6/2021
WO WO 2021/138469 A1 7/2021
WO WO 2021/142343 A1 7/2021
WO WO 2021/155065 A1 8/2021
WO WO 2021/158921 A2 8/2021
WO WO 2021/158995 A1 8/2021
WO WO 2021/158999 A1 8/2021
WO WO 2021/178709 A1 9/2021
WO WO 2021/178717 A2 9/2021
WO WO 2021/178720 A2 9/2021
WO WO 2021/178898 A1 9/2021
WO WO 2021/183761 A1 9/2021
WO WO 2021/183961 A1 9/2021
WO WO 2021/188996 A1 9/2021
WO WO 2021/220020 A1 11/2021
WO WO 2021/222318 A1 11/2021
WO WO 2021/226558 A1 11/2021
WO WO 2021/231505 A1 11/2021
WO WO 2021/233975 A1 11/2021
WO WO 2021/252924 A1 12/2021
WO WO 2022/008510 A2 1/2022
WO WO 2022/013872 A1 1/2022
WO WO 2022/051250 A1 3/2022
WO WO 2022/056254 A2 3/2022
WO WO 2022/067130 A2 3/2022
WO WO 2022/075813 A1 4/2022
WO WO 2022/075816 A1 4/2022
WO WO 2022/092317 A1 5/2022
WO WO 2022/120080 A1 6/2022
WO WO 2022/150790 A2 7/2022
WO WO 2022/164942 A1 8/2022
WO WO 2022/165262 A1 8/2022
WO WO 2022/203905 A1 9/2022
WO WO 2022/204543 A1 9/2022
WO WO 2022/251356 A1 12/2022
WO WO 2022/251712 A1 12/2022
WO WO 2023/015309 A2 2/2023
WO WO 2023/102537 A2 6/2023
WO WO 2023/102538 A1 6/2023
WO WO 2023/102550 A2 6/2023
WO WO 2023/173140 A2 9/2023
WO WO 2024/155741 A1 7/2024
WO WO 2024/155745 A1 7/2024
WO WO 2024/215652 A2 10/2024
WO WO 2024/254346 A1 12/2024

OTHER PUBLICATIONS

English Language Translation of CN-109504707-A (Yong et al.), accessed from Espacenet on Aug. 22, 2025. Originally available as of 2019. (Year: 2019).*

Yang et al. 2016. "Engineering and optimising deaminase fusions for genome editing". Nature Communications, 7, 13330, on IDS filed Oct. 2, 2023 (Year: 2016).*

Mok, Beverly Y et al. "A bacterial cytidine deaminase toxin enables CRISPR-free mitochondrial base editing." Nature vol. 583,7817

(56) References Cited

OTHER PUBLICATIONS (2020): 631-637. doi:10.1038/s41586-020-2477-4, on IDS filed Oct. 2, 2023. (Year: 2020).*
De Moraes, Marcos H et al. "An interbacterial DNA deaminase toxin directly mutagenizes surviving target populations." eLife vol. 10 e62967. Jan. 15, 2021, doi: 10.7554/eLife.62967. (Year: 2021).*
Qi, Xiaolong et al. "Precision modeling of mitochondrial disease in rats via DdCBE-mediated mtDNA editing." Cell discovery vol. 7,195. Oct. 19, 2021, doi: 10.1038/s41421-021-00325-7. (Year: 2021).*
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 61/874,682, filed Sep. 6, 2013, Liu et al.
U.S. Appl. No. 61/874,746, filed Sep. 6, 2013, Liu et al.
U.S. Appl. No. 62/288,661, filed Jan. 29, 2016, Muir et al.
U.S. Appl. No. 62/357,332, filed Jun. 30, 2016, Liu et al.
International Search Report and Written Opinion for PCT/US2021/015580, mailed May 12, 2021.
International Preliminary Report on Patentability for Application No. PCT/US2021/015580, mailed Aug. 11, 2022.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C ->U editing enzyme APOBEC-1 [Peromyscus maniculatus bairdii], XP002793540. Mar. 21, 2016.
[No Author Listed] NCBI Accession No. XP_021505673.1. C ->U editing enzyme APOBEC-1 [Meriones unguiculatus], XP002793541. Jun. 27, 2017.
[No Author Listed] NCBI Reference Sequence: WP_00087959824.1. Oct. 9, 2019. 2 pages.
[No Author Listed] NCBI Reference Sequence: WP_001516895.1. Mar. 13, 2021. 2 pages.
[No Author Listed] Nucleic Acid Data from New England Biolabs. Printed Sep. 28, 2021. 1 page.
[No Author Listed] Score result for SEQ 355 to W02017032580. Muir et al. 2016.
[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed] Transcription activator-like effector nuclease. Wikipedia. Last edited Sep. 27, 2021. Accessed via https://en.wikipedia.org/w/index.php?title=Transcription_activator-like_effector_nuclease&oldid=1046813325 on Sep. 28, 2021. 9 pages.
[No Author Listed], "Enediyne" from Wikipedia. Retrieved from https://en.wikipedia.org/w/index.php?title=Enediyne&oldid=1114086576. Page last edited Oct. 4, 2022. Printed on Oct. 7, 2022. 8 pages.
[No Author Listed], "FokI" from New England Biolabs Inc. Last accessed online via https://www.neb.com/products/r0109-foki#Product%20Information on Mar. 19, 2021. 1 page.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], "Lambda DNA" from Catalog & Technical Reference. New England Biolabs Inc. 2002/2003. pp. 133 and 270-273.
[No Author Listed], Adenine deaminase polypeptide SEQ: 49. EBI Acc. No. BJG44493. Jun. 10, 2021. 1 page.
[No Author Listed], AF10_HUMAN. Uniprot Accession No. P55197. Oct. 1, 1996. Accessible at https://rest.uniprot.org/uniprotkb/P55197.txt. 10 pages.
[No Author Listed], AGFG2_HUMAN. Uniprot Accession No. O95081. Jun. 21, 2004. Accessible at https://rest.uniprot.org/uniprotkb/O95081.txt. 4 pages.
[No Author Listed], AKIB1_HUMAN. Uniprot Accession No. Q9P2G1. Jan. 4, 2005. Accessible at https://rest.uniprot.org/uniprotkb/Q9P2G1.txt. 8 pages.
[No Author Listed], ANFY1_HUMAN. Uniprot Accession No. Q9P2R3. Aug. 4, 2003. Accessible at https://rest.uniprot.org/uniprotkb/Q9P2R3.txt. 10 pages.
[No Author Listed], ANKY1_HUMAN. Uniprot Accession No. Q9P2S6. May 16, 2003. Accessible at https://rest.uniprot.org/uniprotkb/Q9P2S6.txt. 6 pages.
[No Author Listed], Burkholderia gladioli pv. gladioli strain FDAARGOS_389 chromosome 1, complete sequence. NCBI Ref. Seq. No. NZ_CP023522.1. Accessible at https://www.ncbi.nlm.nih.gov/nuccore/nz_cp023522. 2 pages.
[No Author Listed], Burkholderia glumae BGR1 chromosome 2, complete sequence. NCBI Ref. Seq. No. NC_012721.2. Aug. 21, 2022. Accessible at https://www.ncbi.nlm.nih.gov/nuccore/nc_012721.2. 2 pages.
[No Author Listed], Burkholderia glumae LMG 2196 = ATCC 33617 chromosome II, complete sequence. GenBank Acc. No. CP009434.1. Jun. 2, 2015. Accessible at https://www.ncbi.nlm.nih.gov/nuccore/cp009434. 466 pages.
[No Author Listed], CBP_HUMAN. Uniprot Accession No. Q92793. Jul. 15, 1998. Accessible at https://rest.uniprot.org/uniprotkb/Q92793.txt. 31 pages.
[No Author Listed], Chondromyces crocatus strain Cm c5 chromosome, complete genome. NCBI Ref Seq ID: NZ_CP012159.1. Apr. 18, 2022. Accessible at https://www.ncbi.nlm.nih.gov/nuccore/NZ_CP012159. 3 pages.
[No Author Listed], CIZ1_HUMAN. Uniprot Accession No. Q9ULV3. Jan. 24, 2001. Accessible at https://rest.uniprot.org/uniprotkb/Q9ULV3.txt. 10 pages.
[No Author Listed], Double-stranded DNA-specific cytidine deaminase type VI secretion system effector and cognate immunity complex from Burkholderia cenocepacia. RCSB PDB Accession No. 6U08_A. Aug. 13, 2019. doi: 10.2210/pdb6U08/pdb. 18 pages.
[No Author Listed], EMBL Accession No. Q99ZW2. Nov. 2012. 2 pages.
[No Author Listed], Gag-Pol polyprotein. UniProtKB/Swiss-Prot No. P03355.5. Sep. 18, 2019. 18 pages.
[No Author Listed], *Homo sapiens* signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.
[No Author Listed], *Homo sapiens* survival of motor neuron 2, centromeric (SMN2), RefSeqGene (LRG_677) on chromosome 5. NCBI Ref Seq No. NG_008728.1. Aug. 21, 2022. Accessible at https://www.ncbi.nlm.nih.gov/nuccore/NG_008728.1/. 14 pages.
[No Author Listed], hypothetical protein C6361_29650 [*Plantactinospora* sp. BC1]. GenBank Acc. No. AVT32940.1. Accessible at https://www.ncbi.nlm.nih.gov/protein/avt32940. 2 pages.
[No Author Listed], hypothetical protein CO712_00910 [Burkholderia gladioli pv. gladioli]. GenBank Acc. No. ATF83755.1. Feb. 5, 2019. Accessible at https://www.ncbi.nlm.nih.gov/protein/atf83755. 3 pages.
[No Author Listed], hypothetical protein KSE_13070 [Kitasatospora setae KM-6054]. GenBank Acc. No. BAJ27137.1. Accessible at https://www.ncbi.nlm.nih.gov/protein/baj27137. 3 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.

(56) References Cited

OTHER PUBLICATIONS

[No Author Listed], Kitasatospora setae KM-6054, complete sequence. NCBI Ref Seq ID: NC_016109.1. Dec. 15, 2021. Accessible at https://www.ncbi.nlm.nih.gov/nuccore/nc_016109. 2 pages.
[No Author Listed], Multispecies: tRNA adenosine(34) deaminase TadA [Enterobacteriaceae]. NCBI Ref Seq No. WP_001297409.1. Feb. 28, 2022. Retrieved from https://www.ncbi.nlm.nih.gov/protein/WP_001297409.1/. 2 pages.
[No Author Listed], Mus musculus (Mouse). UniProtKB Accession No. P51908 (ABEC1_MOUSE). Oct. 1, 1996. 10 pages.
[No Author Listed], MutL homolog 1. UniProtKB Acc. No. F1MPG0. May 3, 2011. Accessible at https://rest.uniprot.org/unisave/F1MPG0?format=txt&versions=1. 1 page.
[No Author Listed], *Plantactinospora* sp. BC1 chromosome, complete genome. GenBank Acc. No. CP028158.1. Accessible at https://www.ncbi.nlm.nih.gov/nuccore/cp028158. 1770 pages.
[No Author Listed], Rhs family protein [Burkholderia glumae BGR1]. GenBank Acc. No. ACR30728.1. Jan. 30, 2014. Accessible at https://www.ncbi.nlm.nih.gov/protein/acr30728. 2 pages.
[No Author Listed], Rhs repeat-associated core domain protein [Burkholderia glumae LMG 2196 = ATCC 33617]. GenBank Acc. No. AJY63123.1. Jun. 2, 2015. Accessible at https://www.ncbi.nlm.nih.gov/protein/ajy63123. 2 pages.
[No Author Listed], RPOA_EAVBU. Uniprot Accession No. P19811. Feb. 1, 1991. Accessible at https://rest.uniprot.org/uniprotkb/P19811.txt. 19 pages.
[No Author Listed], signal transducer and activator of transcription 3 isoform 1 [*Homo sapiens*]. NCBI Ref Seq No. NP_644805.1. Retrieved from https://www.ncbi.nlm.nih.gov/protein/NP_644805.1/. Nov. 27, 2022. 5 pages.
[No Author Listed], *Streptococcus pyogenes* Cas9 protein. EBI Acc. No. BIR16744. Jan. 2, 20211. 1 page.
[No Author Listed], *Streptococcus pyogenes* Cas9 protein. EBI Acc. No. BIR16747. Jan. 21, 2021. 1 page.
[No Author Listed], *Streptomyces rubrolavendulae* strain MJM4426 chromosome, complete genome. GenBank Acc. No. CP017316.1. Accessible at https://www.ncbi.nlm.nih.gov/nuccore/cp017316. 1276 pages.
[No Author Listed], *Thauera* sp. K11 chromosome, complete genome. NCBI Ref Seq: NZ_CP023439.1. Dec. 21, 2021. Accessible at https://www.ncbi.nlm.nih.gov/nuccore/nz_cp023439. 2 pages.
[No Author Listed], Thermo Fisher Scientific—How Cationic Lipid Mediated Transfection Works, retrieved from the internet Aug. 27, 2015. 2 pages.
[No Author Listed], TRI23_HUMAN. Uniprot Accession No. P36406. Jun. 1, 1994. Accessible at https://rest.uniprot.org/uniprotkb/P36406.txt. 9 pages.
[No Author Listed], tRNA nuclease WapA precursor [Streptomyces rubrolavendulae]. GenBank Acc. No. AOT60363.1. Accessible at https://www.ncbi.nlm.nih.gov/protein/aot60363. 2 pages.
[No Author Listed], tumor-specific antigen. Retrieved from http://www.cancer.gov/publications/dictionaries/cancer-terms/def/tumor-specific-antigen. Retrieved on Oct. 7, 2022. 1 page.
[No Author Listed], type IV secretion protein Rhs [Chondromyces crocatus]. GenBank Acc. No. AKT41505.1. Jul. 30, 2015. Accessible at https://www.ncbi.nlm.nih.gov/protein/AKT41505.1/. 2 pages.
[No Author Listed], type IV secretion protein Rhs [*Thauera* sp. K11]. GenBank Acc. No. ATE59819.1. Sep. 25, 2017. Accessible at https://www.ncbi.nlm.nih.gov/protein/ATE59819.1/. 3 pages.
[No Author Listed], UNGI_BPPB2. Uniprot Acc. No. P14739. Apr. 1, 1990. Accessible at https://rest.uniprot.org/uniprotkb/P14739.txt. 2 pages.
[No Author Listed], YO15_CAEEL. Uniprot Accession No. Q7Z142. Oct. 24, 2003. Accessible at https://rest.uniprot.org/uniprotkb/Q7Z142.txt. 2 pages.
[No Author Listed], ZDH17_HUMAN. Uniprot Accession No. Q8IUH5-3. Apr. 13, 2004. Accessible at https://rest.uniprot.org/uniprotkb/Q8IUH5-3.txt. 4 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.
Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.
Aihara et al., A conformational switch controls the DNA cleavage activity of lambda integrase. Mol Cell. Jul. 2003;12(1):187-98.
Aik et al., Structure of human RNA $N^6$-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Akopian et al., Chimeric recombinases with designed DNA sequence recognition. Proc Natl Acad Sci U S A. Jul. 22, 2003;100(15):8688-91. Epub Jul. 1, 2003.

(56) References Cited

OTHER PUBLICATIONS

Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Alexeyev et al., Selective elimination of mutant mitochondrial genomes as therapeutic strategy for the treatment of NARP and MILS syndromes. Gene Ther. Apr. 2008;15(7):516-23. doi: 10.1038/gt.2008.11. Epub Feb. 7, 2008.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known Y-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science. 1589762.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Andreazza et al., Mitochondrially-targeted APOBEC1 is a potent mtDNA mutator affecting mitochondrial function and organismal fitness in *Drosophila*. Nat Commun. Jul. 23, 2019;10(1):3280. doi: 10.1038/s41467-019-10857-y.
Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Asokan et al., The AAV vector toolkit: poised at the clinical crossroads. Mol Ther. Apr. 2012;20(4):699-708. doi: 10.1038/mt.2011.287. Epub Jan. 24, 2012.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.
Bacman et al., MitoTALEN reduces mutant mtDNA load and restores tRNAAla levels in a mouse model of heteroplasmic mtDNA mutation. Nat Med. Nov. 2018;24(11):1696-1700. doi: 10.1038/s41591-018-0166-8. Epub Sep. 24, 2018. Erratum in: Nat Med. Oct. 5, 2018. Author Manuscript. 15 pages.
Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.

(56) References Cited

OTHER PUBLICATIONS

Badran et al., Development of potent in vivo mutagenesis plasmids with broad mutational spectra. Nat Commun. Oct. 7, 2015;6:8425. doi: 10.1038/ncomms9425.
Badran et al., In vivo continuous directed evolution. Curr Opin Chem Biol. Feb. 2015;24:1-10. doi: 10.1016/j.cbpa.2014.09.040. Epub Nov. 7, 2014.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bae et al., Microhomology-based choice of Cas9 nuclease target sites. Nat Methods. Jul. 2014;11(7):705-6. doi: 10.1038/nmeth.3015.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi: 10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Banskota et al., Engineered virus-like particles for efficient in vivo delivery of therapeutic proteins. Cell. Jan. 20, 2022;185(2):250-265.e16. doi: 10.1016/j.cell.2021.12.021. Epub Jan. 11, 2022.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barmania et al., C-C chemokine receptor type five (CCR5): An emerging target for the control of HIV infection. Appl Transl Genom. May 26, 2013;2:3-16. doi: 10.1016/j.atg.2013.05.004.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an N-terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.
Bass, B.L., RNA editing by adenosine deaminases that act on RNA. Annu Rev Biochem. 2002;71:817-46. doi: 10.1146/annurev.biochem.71.110601.135501. Epub Nov. 9, 2001.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Beaudry et al., Directed evolution of an RNA enzyme. Science. Jul. 31, 1992;257(5070):635-41. doi: 10.1126/science.1496376.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Behr, Gene transfer with synthetic cationic amphiphiles: prospects for gene therapy. Bioconjug Chem. Sep.-Oct. 1994;5(5):382-9. doi: 10.1021/bc00029a002.
Bell et al., Ribozyme-catalyzed excision of targeted sequences from within RNAs. Biochemistry. Dec. 24, 2002;41(51):15327-33. doi: 10.1021/bi0267386.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, HCN channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Bentin, T., A ribozyme transcribed by a ribozyme. Artif DNA PNA XNA. Apr. 2011;2(2):40-42. doi: 10.4161/adna.2.2.16852.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.

(56) References Cited

OTHER PUBLICATIONS

Bertolotti et al., Toward genosafe endonuclease-boosted gene targeting using breakthrough CRISP/Cas9 for next generation stem cell gene therapy culminating in efficient ex VIVO in VIVO gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.

Bertrand et al., Localization of ASH1 mRNA particles in living yeast. Mol Cell. Oct. 1998;2(4):437-45. doi: 10.1016/s1097-2765(00)80143-4.

Bertsimas et al., Simulated annealing. Statistical Science. Feb. 1993;8(1):10-15. doi: 10.1214/ss/1177011077.

Bessen et al., High-resolution specificity profiling and off-target prediction for site-specific DNA recombinases. Nat Commun. Apr. 26, 2019;10(1):1937. doi: 10.1038/s41467-019-09987-0.

Beumer et al., Efficient gene targeting in *Drosophila* with zinc-finger nucleases. Genetics. Apr. 2006;172(4):2391-403. Epub Feb. 1, 2006.

Bhagwat, DNA-cytosine deaminases: from antibody maturation to antiviral defense. DNA Repair (Amst). Jan. 5, 2004;3(1):85-9.

Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.

Bibb et al., Integration and excision by the large serine recombinase phiRv1 integrase. Mol Microbiol. Mar. 2005;55(6):1896-910. doi: 10.1111/j.1365-2958.2005.04517.x.

Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.

Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.

Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.

Birling et al., Site-specific recombinases for manipulation of the mouse genome. Methods Mol Biol. 2009;561:245-63. doi: 10.1007/978-1-60327-019-9_16.

Biswas et al., A structural basis for allosteric control of DNA recombination by lambda integrase. Nature. Jun. 23, 2005;435(7045):1059-66. doi: 10.1038/nature03657.

Bitinaite et al., FokI dimerization is required for DNA cleavage. Proc Natl Acad Sci U S A. Sep. 1, 1998;95(18):10570-5.

Blaese et al., Vectors in cancer therapy: how will they deliver? Cancer Gene Ther. Dec. 1995;2(4):291-7.

Blain et al., Nuclease activities of Moloney murine leukemia virus reverse transcriptase. Mutants with altered substrate specificities. J Biol Chem. Nov. 5, 1993;268(31):23585-92.

Blaisonneau et al., A circular plasmid from the yeast Torulaspora delbrueckii. Plasmid. 1997;38(3):202-9. doi: 10.1006/plas.1997.1315.

Blau et al., A proliferation switch for genetically modified cells. PNAS Apr. 1, 1997 94 (7) 3076-3081; https://doi.org/10.1073/pnas.94.7.3076.

Blauw et al., SMN1 gene duplications are associated with sporadic ALS. Neurology. Mar. 13, 2012;78(11):776-80. doi: 10.1212/WNL.0b013e318249f697. Epub Feb. 8, 2012.

Bloom et al., Evolving strategies for enzyme engineering. Curr Opin Struct Biol. Aug. 2005;15(4):447-52.

Boch, TALEs of genome targeting. Nat Biotechnol. Feb. 2011;29(2):135-6. Doi: 10.1038/nbt.1767.

Böck et al., Selenocysteine: the 21st amino acid. Mol Microbiol. Mar. 1991;5(3):515-20.

Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.

Boeckle et al., Melittin analogs with high lytic activity at endosomal pH enhance transfection with purified targeted PEI polyplexes. J Control Release. May 15, 2006;112(2):240-8. Epub Mar. 20, 2006.

Boersma et al., Selection strategies for improved biocatalysts. FEBS J. May 2007;274(9):2181-95.

Bogdanove et al., Engineering altered protein-DNA recognition specificity. Nucleic Acids Res. Jun. 1, 2018;46(10):4845-4871. doi: 10.1093/nar/gky289.

Bogdanove et al., TAL effectors: customizable proteins for DNA targeting. Science. Sep. 30, 2011;333(6051):1843-6. doi: 10.1126/science.1204094.

Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.

Bolotin et al., Clustered regularly interspaced short palindrome repeats (CRISPRs) have spacers of extrachromosomal origin. Microbiology. Aug. 2005;151(Pt 8):2551-61.

Bolusani et al., Evolution of variants of yeast site-specific recombinase Flp that utilize native genomic sequences as recombination target sites. Nucleic Acids Res. 2006;34(18):5259-69. Epub Sep. 26, 2006.

Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.

Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.

Borman, Improved route to single-base genome editing. Chemical & Engineering News, Apr. 25, 2016;94(17)p5. http://cen.acs.org/articles/94/117/Improved-route-single-base-genome.html.

Bosch et al., Precise genome engineering in *Drosophila* using prime editing. Proc Natl Acad Sci U S A. Jan. 5, 2021;118(1):e2021996118. doi: 10.1073/pnas.2021996118.

Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.

Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.

Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.

Box et al., A multi-domain protein system based on the HC fragment of tetanus toxin for targeting DNA to neuronal cells. J Drug Target. Jul. 2003;11(6):333-43. doi: 10.1080/1061186310001634667.

Branden and Tooze, Introduction to Protein Structure. 1999; 2nd edition. Garland Science Publisher: 3-12.

Braun et al., Immunogenic duplex nucleic acids are nuclease resistant. J Immunol. Sep. 15, 1988;141(6):2084-9.

Brierley et al., Viral RNA pseudoknots: versatile motifs in gene expression and replication. Nat Rev Microbiol. Aug. 2007;5(8):598-610. doi: 10.1038/nrmicro1704.

Briner et al., Guide RNA functional modules direct Cas9 activity and orthogonality. Mol Cell. Oct. 23, 2014;56(2):333-339. doi: 10.1016/j.molcel.2014.09.019.

Britt et al., Re-engineering plant gene targeting. Trends Plant Sci. Feb. 2003;8(2):90-5.

Brouns et al., Small CRISPR RNAs guide antiviral defense in prokaryotes. Science. Aug. 15, 2008;321(5891):960-4. doi: 10.1126/science.1159689.

Brown et al., A mammalian protein targeted by G1-arresting rapamycin-receptor complex. Nature. Jun. 30, 1994;369(6483):756-8. doi: 10.1038/369756a0.

(56) References Cited

OTHER PUBLICATIONS

Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALATI noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brutlag et al., Improved sensitivity of biological sequence database searches. Comput Appl Biosci. Jul. 1990;6(3):237-45. doi: 10.1093/bioinformatics/6.3.237.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Buckley et al., Targeting the von Hippel-Lindau E3 ubiquitin ligase using small molecules to disrupt the VHL/HIF-1 a interaction. J Am Chem Soc. Mar. 14, 2012;134(10):4465-8. doi: 10.1021/ja209924v. Epub Feb. 27, 2012.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013; 1010:3-17. doi: 10.1007/978-1-62703-411-1_1.
Bulow et al., Multienzyme systems obtained by gene fusion. Trends Biotechnol. Jul. 1991;9(7):226-31.
Burke et al., Activating mutations of Tn3 resolvase marking interfaces important in recombination catalysis and its regulation. Mol Microbiol. Feb. 2004;51(4):937-48.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003;10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Canver et al., Customizing the genome as therapy for the β-hemoglobinopathies. Blood. May 26, 2016;127(21):2536-45. doi: 10.1182/blood-2016-01-678128. Epub Apr. 6, 2016.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Cardona et al., An expression vector containing a rhamnose-inducible promoter provides tightly regulated gene expression in Burkholderia cenocepacia. Plasmid. Nov. 2005;54(3):219-28. doi: 10.1016/j.plasmid.2005.03.004. Epub May 31, 2005.
Carelli et al., Pathogenic expression of homoplasmic mtDNA mutations needs a complex nuclear-mitochondrial interaction. Trends Genet. May 2003;19(5):257-62. doi: 10.1016/S0168-9525(03)00072-6.
Cargill et al., Characterization of single-nucleotide polymorphisms in coding regions of human genes. Nat Genet. Jul. 1999;22(3):231-8.
Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Carlson et al., Targeting DNA With Fingers and TALENs. Mol Ther Nucleic Acids. Jan. 24, 2012;1(1):e3. doi: 10.1038/mtna.2011.5.
Caron et al., Intracellular delivery of a Tat-eGFP fusion protein into muscle cells. Mol Ther. Mar. 2001;3(3):310-8.
Carr et al., Genome engineering. Nat Biotechnol. Dec. 2009;27(12):1151-62. doi: 10.1038/nbt.1590.
Carroll et al., Gene targeting in *Drosophila* and Caenorhabditis elegans with zinc-finger nucleases. Methods Mol Biol. 2008;435:63-77. doi: 10.1007/978-1-59745-232-8_5.

(56) References Cited

OTHER PUBLICATIONS

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.
Chan et al., Molecular recording of mammalian embryogenesis. Nature. Jun. 2019;570(7759):77-82. doi: 10.1038/s41586-019-1184-5. Epub May 13, 2019.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Chapman et al., Playing the end game: DNA double-strand break repair pathway choice. Mol Cell. Aug. 24, 2012;47(4):497-510. doi: 10.1016/j.molcel.2012.07.029.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.
Charpentier et al., Biotechnology: Rewriting a genome. Nature. Mar. 7, 2013;495(7439):50-1. doi: 10.1038/495050a.
Chatterjee et al., A Cas9 with PAM recognition for adenine dinucleotides. Nat Commun. May 18, 2020;11(1):2474. doi: 10.1038/s41467-020-16117-8.
Chatterjee et al., Robust Genome Editing of Single-Base PAM Targets; with Engineered ScCas9 Variants. bioRxiv. doi: 10.1101/620351. Posted Apr. 26, 2019.
Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.
Chavez et al., Therapeutic applications of the ΦC31 integrase system. Curr Gene Ther. Oct. 2011;11(5):375-81. Review.
Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Alterations in PMS2, MSH2 and MLH1 expression in human prostate cancer. Int J Oncol. May 2003;22(5):1033-43.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Chen et al., Enhanced prime editing systems by manipulating cellular determinants of editing outcomes. Cell. Oct. 28, 2021;184(22):5635-5652.e29. doi: 10.1016/j.cell.2021.09.018. Epub Oct. 14, 2021.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.

(56) References Cited

OTHER PUBLICATIONS

Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.
Chesnoy et al., Structure and function of lipid-DNA complexes for gene delivery. Annu Rev Biophys Biomol Struct. 2000;29:27-47.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chichili et al., Linkers in the structural biology of protein-protein interactions. Protein Science. 2013;22:153-67.
Chin et al., Optimized Mitochondrial Targeting of Proteins Encoded by Modified mRNAs Rescues Cells Harboring Mutations in mtATP6. Cell Rep. Mar. 13, 2018;22(11):2818-2826. doi: 10.1016/j.celrep.2018.02.059.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine—proline mutation in the H1 subdomain of keratin 1 causes epidermolytic hyperkeratosis. Cell. Sep. 4, 1992;70(5):821-8.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999; 181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., (6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., A Tn7-based broad-range bacterial cloning and expression system. Nat Methods. Jun. 2005;2(6):443-8. doi: 10.1038/nmeth765.
Choi et al., Genetic tools for select-agent-compliant manipulation of Burkholderia pseudomallei. Appl Environ Microbiol. Feb. 2008;74(4):1064-75. doi: 10.1128/AEM.02430-07. Epub Dec. 21, 2007. Erratum in: Appl Environ Microbiol. Aug. 2008;74(16):5265.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Choi et al., Translesion synthesis across abasic lesions by human B-family and Y-family DNA polymerases α, δ, η, ι, κ, and REV1. J Mol Biol. Nov. 19, 2010;404(1):34-44. doi: 10.1016/j.jmb.2010.09.015. Epub Oct. 1, 2010.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.

(56) References Cited

OTHER PUBLICATIONS

Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Corcia et al., The importance of the SMN genes in the genetics of sporadic ALS. Amyotroph Lateral Scler. Oct.-Dec. 2009;10(5-6):436-40. doi: 10.3109/17482960902759162.
Cornu et al., Refining strategies to translate genome editing to the clinic. Nat Med. Apr. 3, 2017;23(4):415-423. doi: 10.1038/nm.4313.
Corti et al., Genetic correction of human induced pluripotent stem cells from patients with spinal muscular atrophy. Sci Transl Med. Dec. 19, 2012;4(165):165ra162. doi: 10.1126/scitranslmed.3004108.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/138945011701151217110917.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Craven et al., Recent Advances in Mitochondrial Disease. Annu Rev Genomics Hum Genet. Aug. 31, 2017;18:257-275. doi: 10.1146/annurev-genom-091416-035426. Epub Apr. 17, 2017.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Crystal, Transfer of genes to humans: early lessons and obstacles to success. Science. Oct. 20, 1995;270(5235):404-10. doi: 10.1126/science.270.5235.404.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Database EBI Accession No. ADE34233 Jan. 29, 2004.
Database EBI Accession No. BFF09785. May 31, 2018. 2 pages.
Database EBI Accession No. BGE38086. Jul. 25, 2019. 2 pages.

(56) References Cited

OTHER PUBLICATIONS

Database UniProt Accession No. G813E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.
Davis et al., Assaying Repair at DNA Nicks. Methods Enzymol. 2018;601:71-89. doi: 10.1016/bs.mie.2017.12.001. Epub Feb. 1, 2018.
Davis et al., DNA double strand break repair via non-homologous end-joining. Transl Cancer Res. Jun. 2013;2(3):130-143.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De La Peña et al., The Hammerhead Ribozyme: A Long History for a Short RNA. Molecules. Jan. 4, 2017;22(1):78. doi: 10.3390/molecules22010078.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 β-globin gene targeting in human haematopoietic stem cells. Nature. Nov. 17, 2016;539(7629):384-389. doi: 10.1038/nature20134. Epub Nov. 7, 2016.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., A system for the continuous directed evolution of proteases rapidly reveals drug-resistance mutations. Nat Commun. Oct. 30, 2014;5:5352. doi: 10.1038/ncomms6352.
Dickinson et al., Experimental interrogation of the path dependence and stochasticity of protein evolution using phage-assisted continuous evolution. Proc Natl Acad Sci USA. May 2013;110(22):9007-12.
Dillon, Regulating gene expression in gene therapy. Trends Biotechnol. May 1993;11(5):167-73. doi: 10.1016/0167-7799(93)90109-M.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 20106.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Dolan et al., Trans-splicing with the group I intron ribozyme from Azoarcus. RNA. Feb. 2014;20(2):202-13. doi: 10.1261/rna.041012.113. Epub Dec. 16, 2013.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

(56) References Cited

OTHER PUBLICATIONS

Doudna et al., Genome editing. The new frontier of genome engineering with CRISPR-Cas9. Science. Nov. 28, 2014;346(6213):1258096. doi: 10.1126/science.1258096.
Doudna, The promise and challenge of therapeutic genome editing. Nature. Feb. 2020;578(7794):229-236. doi: 10.1038/s41586-020-1978-5. Epub Feb. 12, 2020.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci USA. Aug. 15, 1991;88(16):7160-4.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dubois et al., Retroviral RNA Dimerization: From Structure to Functions. Front Microbiol. Mar. 22, 2018;9:527. doi: 10.3389/fmicb.2018.00527.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
East-Seletsky et al., Two distinct RNase activities of CRISPR-C2c2 enable guide-RNA processing and RNA detection. Nature Oct. 2016;538(7624):270-3.
Edlund et al., Cell-specific expression of the rat insulin gene: evidence for role of two distinct 5' flanking elements. Science. Nov. 22, 1985;230(4728):912-6. doi: 10.1126/science.3904002.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Eick et al., Robustness of Reconstructed Ancestral Protein Functions to Statistical Uncertainty. Mol Biol Evol. Feb. 1, 2017;34(2):247-261. doi: 10.1093/molbev/msw223.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Eisenberg et al., A-to-I RNA editing—immune protector and transcriptome diversifier. Nat Rev Genet. Aug. 2018;19(8):473-490. doi: 10.1038/s41576-018-0006-1.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Elashal et al., Site-selective chemical cleavage of peptide bonds. Chem Commun (Camb). May 7, 2016;52(37):6304-7. doi: 10.1039/c6cc01509c. Epub Apr. 18, 2016.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Emery et al., HCN2 ion channels play a central role in inflammatory and neuropathic pain. Science. Sep. 9, 2011;333(6048):1462-6. doi: 10.1126/science.1206243.
Endo et al., Toward establishing an efficient and versatile gene targeting system in higher plants. Biocatalysis and Agricultural Biotechnology 2014;3,(1):2-6.
Engel et al., The emerging role of mRNA methylation in normal and pathological behavior. Genes Brain Behav. Mar. 2018;17(3):e12428. doi: 10.1111/gbb.12428. Epub Nov. 17, 2017.
Engelward et al., Base excision repair deficient mice lacking the Aag alkyladenine DNA glycosylase. Proc Natl Acad Sci U S A. Nov. 25, 1997;94(24):13087-92.
England, Unnatural amino acid mutagenesis: a precise tool for probing protein structure and function. Biochemistry. Sep. 21, 2004;43(37):11623-9.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.
Epstein, HSV-1-based amplicon vectors: design and applications. Gene Ther. Oct. 2005;12 Suppl 1:S154-8. doi: 10.1038/sj.gt.3302617.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Estacion et al., A sodium channel gene SCN9A polymorphism that increases nociceptor excitability. Ann Neurol. Dec. 2009;66(6):862-6. doi: 10.1002/ana.21895.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.
Evans et al., Semisynthesis of cytotoxic proteins using a modified protein splicing element. Protein Sci. Nov. 1998;7(11):2256-64. doi: 10.1002/pro.5560071103.

(56) References Cited

OTHER PUBLICATIONS

Evans et al., The cyclization and polymerization of bacterially expressed proteins using modified self-splicing inteins. J Biol Chem. Jun. 25, 1999;274(26):18359-63. doi: 10.1074/jbc.274.26.18359.
Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fagerlund et al., The Cpf1 CRISPR-Cas protein expands genome-editing tools. Genome Biology Nov. 17, 2015;16:251. https://doi.org/10.1186/s13059-015-0824-9.
Falnes et al., DNA repair by bacterial AlkB proteins. Res Microbiol. Oct. 2003;154(8):531-8. doi: 10.1016/S0923-2508(03)00150-5.
Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.
Fang et al., Human strand-specific mismatch repair occurs by a bidirectional mechanism similar to that of the bacterial reaction. J Biol Chem. Jun. 5, 1993;268(16):11838-44.
Fang et al., Synthetic Studies Towards Halichondrins: Synthesis of the Left Halves of Norhalichondrins and Homohalichondrins. Tetrahedron Letters 1992;33(12):1557-1560.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Farhood et al., Codelivery to mammalian cells of a transcriptional factor with cis-acting element using cationic liposomes. Anal Biochem. Feb. 10, 1995;225(1):89-93.
Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.
Fazli et al., In-Frame and Unmarked Gene Deletions in Burkholderia cenocepacia via an Allelic Exchange System Compatible with Gateway Technology. Appl Environ Microbiol. Jun. 2015;81(11):3623-30. doi: 10.1128/AEM.03909-14. Epub Mar. 20, 2015.
Feldstein et al., Two sequences participating in the autolytic processing of satellite tobacco ringspot virus complementary RNA. Gene. Oct. 15, 1989;82(1):53-61. doi: 10.1016/0378-1119(89)90029-2.
Felletti et al., Twister Ribozymes as Highly Versatile Expression Platforms for Artificial Riboswitches. Nat Commun. Sep. 27, 2016;7:12834. doi: 10.1038/ncomms12834.
Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.
Feng et al., Efficient genome editing in plants using a CRISPR/Cas system. Cell Res. Oct. 2013;23(10):1229-32. doi: 10.1038/cr.2013.114. Epub Aug. 20, 2013.
Feng et al., Human L1 retrotransposon encodes a conserved endonuclease required for retrotransposition. Cell. Nov. 29, 1996;87(5):905-16. doi: 10.1016/s0092-8674(00)81997-2.
Ferreira Da Silva et al., Prime editing efficiency and fidelity are enhanced in the absence of mismatch repair. Nat Commun. Feb. 9, 2022;13(1):760. doi: 10.1038/s41467-022-28442-1.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Feuk, Inversion variants in the human genome: role in disease and genome architecture. Genome Med. Feb. 12, 2010;2(2):11. doi: 10.1186/gm132.
Filippov et al., A novel type of RNase III family proteins in eukaryotes. Gene. Mar. 7, 2000;245(1):213-21. doi: 10.1016/s0378-1119(99)00571-5.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Filograna et al., Modulation of mtDNA copy number ameliorates the pathological consequences of a heteroplasmic mtDNA mutation in the mouse. Sci Adv. Apr. 3, 2019;5(4):eaav9824. doi: 10.1126/sciadv.aav9824.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fire et al., Potent and specific genetic interference by double-stranded RNA in Caenorhabditis elegans. Nature. Feb. 19, 1998;391(6669):806-11. doi: 10.1038/35888.
Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in—myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fogg et al., Genome Integration and Excision by a New Streptomyces Bacteriophage, ϕJoe. Appl Environ Microbiol. Feb. 15, 2017;83(5):e02767-16. doi: 10.1128/AEM.02767-16.
Fogg et al., New applications for phage integrases. J Mol Biol. Jul. 29, 2014;426(15):2703-16. doi: 10.1016/j.jmb.2014.05.014. Epub May 22, 2014.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.
Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short- and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.

(56) References Cited

OTHER PUBLICATIONS

Friedman, J. H., Greedy function approximation: A gradient boosting machine. Ann. Statist. Oct. 2001;29(5):1189-232. doi: 10.1214/aos/1013203451.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fu et al., Targeted genome editing in human cells using CRISPR/Cas nucleases and truncated guide RNAs. Methods Enzymol. 2014;546:21-45. doi: 10.1016/B978-0-12-801185-0.00002-7.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Fusi et al., In Silico Predictive Modeling of CRISPR/Cas9 guide efficiency. Jun. 26, 2015; bioRxiv. http://dx.doi.org/10.1101/021568.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive C•G->G•C CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gammage et al., Genome editing in mitochondria corrects a pathogenic mtDNA mutation in vivo. Nat Med. Nov. 2018;24(11):1691-1695. doi: 10.1038/s41591-018-0165-9. Epub Sep. 24, 2018. Autor Manuscript. 16 pages.
Gammage et al., Mitochondrial Genome Engineering: The Revolution May Not Be CRISPR-Ized. Trends Genet. Feb. 2018;34(2):101-110. doi: 10.1016/j.tig.2017.11.001. Epub Nov. 24, 2017.
Gammage et al., Mitochondrially targeted ZFNs for selective degradation of pathogenic mitochondrial genomes bearing large-scale deletions or point mutations. EMBO Mol Med. Apr. 2014;6(4):458-66. doi: 10.1002/emmm.201303672. Epub Feb. 24, 2014.
Gammage et al., Near-complete elimination of mutant mtDNA by iterative or dynamic dose-controlled treatment with mtZFNs. Nucleic Acids Res. Sep. 19, 2016;44(16):7804-16. doi: 10.1093/nar/gkw676. Epub Jul. 27, 2016.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.
Gao et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Prime editing in mice reveals the essentiality of a single base in driving tissue-specific gene expression. Genome Biol. Mar. 16, 2021;22(1):83. doi: 10.1186/s13059-021-02304-3.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garg et al., Engineering synthetic TAL effectors with orthogonal target sites. Nucleic Acids Res. Aug. 2012;40(15):7584-95. doi: 10.1093/nar/gks404. Epub May 11, 2012.
Garibyan et al., Use of the rpoB gene to determine the specificity of base substitution mutations on the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Directed evolution of adenine base editors with increased activity and therapeutic application. Nat Biotechnol. Jul. 2020;38(7):892-900. doi: 10.1038/s41587-020-0491-6. Epub Apr. 13, 2020.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
Geisenberger et al., Production of -acyl-L-homoserine lactones by P. aeruginosa isolates from chronic lung infections associated with cystic fibrosis. FEMS Microbiol Lett. Mar. 15, 2000;184(2):273-8. doi: 10.1111/j.1574-6968.2000.tb09026.x.
GenBank Accession No. J01600.1. Brooks et al., *E.coli* dam gene coding for DNA adenine methylase. Apr. 26, 1993.

(56) References Cited

OTHER PUBLICATIONS

GenBank Accession No. U07651.1. Lu, *Escherichia coli* K12 negative regulator of replication initiation (seqA) gene, complete cds. Jul. 19, 1994.
GenBank Submission; NIH/NCBI Accession No. 4UN5_B. Anders et al., Jul. 23, 2014. 5 pages.
GenBank Submission; NIH/NCBI Accession No. NM_001319224.2. Umar et al., Apr. 21, 2021. 7 pages.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. AIT42264.1. Hyun et al., Oct. 15, 2014. 2 pages.
GenBank Submission; NIH/NCBI, Accession No. AKA60242.1. Tong et al., Apr. 5, 2015. 1 page.
GenBank Submission; NIH/NCBI, Accession No. AKQ21048.1. Gilles et al., Jul. 19, 2015. 1 page.
GenBank Submission; NIH/NCBI, Accession No. AKS40380.1. Nodvig et al., Aug. 2, 2015. 1 page.
GenBank Submission; NIH/NCBI, Accession No. APG80656.1. Burstein et al., Dec. 10, 2016. 1 pages.
GenBank Submission; NIH/NCBI, Accession No. AYD60528.1. Ram et al., Oct. 2, 2018. 1 page.
GenBank Submission; NIH/NCBI, Accession No. BDB43378. Zhang et al., Aug. 11, 2016. 2 pages.
GenBank Submission; NIH/NCBI, Accession No. J04623. Kita et al., Apr. 26, 1993. 2 pages.
GenBank Submission; NIH/NCBI, Accession No. KR710351.1. Sahni et al., Jun. 1, 2015. 2 pages.
GenBank Submission; NIH/NCBI, Accession No. NC 002737.2. Nasser et al., Feb. 7, 2021. 2 pages.
GenBank Submission; NIH/NCBI, Accession No. NC_000001.11. Gregory et al., Jun. 6, 2016. 3 pages.
GenBank Submission; NIH/NCBI, Accession No. NC_002737.1. Ferretti et al., Jun. 27, 2013. 1 page.
GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
GenBank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NG_008692.2. McClintock et al., Aug. 27, 2018. 33 pages.
GenBank Submission; NIH/NCBI, Accession No. NM_000311.5. Alves et al., Mar. 7, 2021. 5 pages.
GenBank Submission; NIH/NCBI, Accession No. NM_001319224. Umar et al., Apr. 21, 2021. 7 pages.
GenBank Submission; NIH/NCBI, Accession No. NM_002945.3. Weiser et al., Sep. 3, 2017. 5 pages.
GenBank Submission; NIH/NCBI, Accession No. NM_002946.5. Kavli et al., Jun. 26, 2021. 5 pages.
GenBank Submission; NIH/NCBI, Accession No. NM_002947.4. Xiao et al., May 1, 2019. 4 pages.
GenBank Submission; NIH/NCBI, Accession No. NM_003686. Umar et al., Apr. 9, 2021. 7 pages.
GenBank Submission; NIH/NCBI, Accession No. NM_003686.4. Umar et al., Apr. 9, 2021. 7 pages.
GenBank Submission; NIH/NCBI, Accession No. NM_006027. Umar et al., Apr. 10, 2021. 7 pages.
GenBank Submission; NIH/NCBI, Accession No. NM_174936. Guo et al., Oct. 28, 2015. 6 pages.
GenBank Submission; NIH/NCBI, Accession No. NM_206933.2. Khalaileh et al., Sep. 16, 2018. 12 pages.
GenBank Submission; NIH/NCBI, Accession No. NP_000302.1. Alves et al., Mar. 7, 2021. 4 pages.
GenBank Submission; NIH/NCBI, Accession No. NP_001075493.1. Schiaffella et al., Jun. 24, 2018. 2 pages.
GenBank Submission; NIH/NCBI, Accession No. NP_001157741.1. Zeng et al., Sep. 17, 2018. 3 pages.
GenBank Submission; NIH/NCBI, Accession No. NP_001157742.1. Zeng et al., Oct. 21, 2018. 3 pages.
GenBank Submission; NIH/NCBI, Accession No. NP_001243439.1. Lee et al., Jul. 26, 2021. 4 pages.
GenBank Submission; NIH/NCBI, Accession No. NP_033040.2. Liu et al., Jun. 23, 2018. 2 pages.
GenBank Submission; NIH/NCBI, Accession No. NP_076161.2. Wade et al., Jun. 20, 2021. 4 pages.
GenBank Submission; NIH/NCBI, Accession No. NP_358988.1. Hoskins et al., Jan. 11, 2017. 2 pages.
GenBank Submission; NIH/NCBI, Accession No. NP_391970.1. Borriss et al., Feb. 12, 2021. 3 pages.
GenBank Submission; NIH/NCBI, Accession No. NP_472073.1. Glaser et al., Jun. 27, 2013. 2 pages.
GenBank Submission; NIH/NCBI, Accession No. NP_628093.1. Hsiao et al., Aug. 3, 2016. 2 pages.
GenBank Submission; NIH/NCBI, Accession No. NP_955579.1. Chen et al., Aug. 13, 2018. 5 pages.
GenBank Submission; NIH/NCBI, Accession No. NP_996816.2. Fu et al., Sep. 22, 2019. 9 pages.
GenBank Submission; NIH/NCBI, Accession No. P42212. Prasher et al., Mar. 19, 2014. 7 pages.
GenBank Submission; NIH/NCBI, Accession No. QBJ66766. Duan et al. Aug. 12, 2020. 2 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_002989955.1. No Author Listed, May 6, 2013. 1 page.
GenBank Submission; NIH/NCBI, Accession No. WP_010922251.1. No Author Listed, May 15, 2013. 1 page.
GenBank Submission; NIH/NCBI, Accession No. WP_011054416.1. No Author Listed, May 15, 2013. 1 page.
GenBank Submission; NIH/NCBI, Accession No. WP_011284745.1. No Author Listed, May 16, 2013. 1 page.
GenBank Submission; NIH/NCBI, Accession No. WP_011285506.1. No Author Listed, May 16, 2013. 1 page.
GenBank Submission; NIH/NCBI, Accession No. WP_011527619.1. No Author Listed, May 16, 2013. 1 page.
GenBank Submission; NIH/NCBI, Accession No. WP_012560673.1. No Author Listed, May 17, 2013. 1 page.
GenBank Submission; NIH/NCBI, Accession No. WP_014407541.1. No Author Listed, May 18, 2013. 1 page.
GenBank Submission; NIH/NCBI, Accession No. WP_016631044.1. Haft et al., Sep. 22, 2020. 1 page.
GenBank Submission; NIH/NCBI, Accession No. WP_020905136.1. No Author Listed, Jul. 25, 2013. 1 page.
GenBank Submission; NIH/NCBI, Accession No. WP_023080005.1. No Author Listed, Oct. 27, 2013. 1 page.
GenBank Submission; NIH/NCBI, Accession No. WP_023610282.1. No Author Listed, Nov. 27, 2013. 1 page.

(56) References Cited

OTHER PUBLICATIONS

GenBank Submission; NIH/NCBI, Accession No. WP_030125963.1. No Author Listed, Jul. 9, 2014. 1 page.
GenBank Submission; NIH/NCBI, Accession No. WP_030126706.1. No Author Listed, Jul. 9, 2014. 1 page.
GenBank Submission; NIH/NCBI, Accession No. WP_031386437.1. No Author Listed., Sep. 23, 2019. 1 page.
GenBank Submission; NIH/NCBI, Accession No. WP_031488318.1. No Author Listed., Aug. 5, 2014. 1 page.
GenBank Submission; NIH/NCBI, Accession No. WP_031589969.1. Haft et al., Oct. 9, 2019. 2 pages.
GenBank Submission; NIH/NCBI, Accession No. WP_032460140.1. No Author Listed, Oct. 4, 2014. 1 page.
GenBank Submission; NIH/NCBI, Accession No. WP_032461047.1. No Author Listed, Oct. 4, 2014. 1 page.
GenBank Submission; NIH/NCBI, Accession No. WP_032462016.1. Haft et al., Oct. 4, 2014. 1 page.
GenBank Submission; NIH/NCBI, Accession No. WP_032462936.1. No Author Listed, Oct. 4, 2014. 1 page.
GenBank Submission; NIH/NCBI, Accession No. WP_032464890.1. No Author Listed, Oct. 4, 2014. 1 page.
GenBank Submission; NIH/NCBI, Accession No. WP_038431314.1. No Author Listed, Dec. 26, 2014. 1 page.
GenBank Submission; NIH/NCBI, Accession No. WP_038432938.1. No Author Listed, Dec. 26, 2014. 1 page.
GenBank Submission; NIH/NCBI, Accession No. WP_038434062.1. No Author Listed, Dec. 26, 2014. 1 page.
GenBank Submission; NIH/NCBI, Accession No. WP_044924278.1. Haft et al., Oct. 9, 2019. 2 pages.
GenBank Submission; NIH/NCBI, Accession No. WP_047338501.1. Haft et al., Oct. 9, 2019. 2 pages.
GenBank Submission; NIH/NCBI, Accession No. WP_048327215.1. No Author Listed, Jun. 26, 2015. 1 page.
GenBank Submission; NIH/NCBI, Accession No. WP_049519324.1. No Author Listed, Jul. 20, 2015. 1 page.
GenBank Submission; NIH/NCBI, Accession No. WP_060798984.1. Haft et al., Oct. 9, 2019. 2 pages.
GenBank Submission; NIH/NCBI, Accession No. WP_062913273.1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515.1. No Author Listed., Sep. 23, 2019. 1 page.
GenBank Submission; NIH/NCBI, Accession No. WP_118538418.1. No Author Listed., Oct. 13, 2019. 1 page.
GenBank Submission; NIH/NCBI, Accession No. WP_119223642.1. No Author Listed., Oct. 13, 2019. 1 page.
GenBank Submission; NIH/NCBI, Accession No. WP_119227726.1. No Author Listed., Oct. 13, 2019. 1 page.
GenBank Submission; NIH/NCBI, Accession No. WP_119623382.1. No Author Listed., Oct. 13, 2019. 1 page.
GenBank Submission; NIH/NCBI, Accession No. WP_132221894.1. No Author Listed., Sep. 23, 2019. 1 page.
GenBank Submission; NIH/NCBI, Accession No. WP_133478044.1. Haft et al., Oct. 9, 2019. 2 pages.
GenBank Submission; NIH/NCBI, Accession No. XP_003314669.1. No Author Listed, Mar. 20, 2018. 2 pages.
GenBank Submission; NIH/NCBI, Accession No. XP_026671085.1. No Author Listed, Oct. 17, 2018. 1 page.
GenBank Submission; NIH/NCBI, Accession No. YP_002004532.1. Villegas et al., Oct. 11, 2021. 2 pages.
GenBank Submission; NIH/NCBI, Accession No. YP_002342100.1. Bernardini et al., Jun. 10, 2013. 2 pages.
GenBank Submission; NIH/NCBI, Accession No. YP_002344900.1. Gundogdu et al., Mar. 19, 2014. 2 pages.
GenBank Submission; NIH/NCBI, Accession No. YP_006589943.1. Lynch et al., Oct. 15, 2021. 2 pages.
GenBank Submission; NIH/NCBI, Accession No. YP_009137104.1. Davison, Aug. 13, 2018. 2 pages.
GenBank Submission; NIH/NCBI, Accession No. YP_009283008.1. Bernardini et al., Sep. 23, 2016. 2 pages.
GenBank Submission; NIH/NCBI, Accession No. YP_820832.1. Makarova et al., Aug. 27, 2013. 2 pages.
Geng et al., In vitro studies of DNA mismatch repair proteins. Anal Biochem. Jun. 15, 2011;413(2):179-84. doi: 10.1016/j.ab.2011.02.017. Epub Feb. 15, 2011.
Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.
Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Synthetic zinc finger proteins: the advent of targeted gene regulation and genome modification technologies. Acc Chem Res. Aug. 19, 2014;47(8):2309-18. doi: 10.1021/ar500039w. Epub May 30, 2014.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.

(56) References Cited

OTHER PUBLICATIONS

Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gopal et al., Widespread Chromosomal Losses and Mitochondrial DNA Alterations as Genetic Drivers in Hürthle Cell Carcinoma. Cancer Cell. Aug. 13, 2018;34(2):242-255.e5. doi: 10.1016/j.ccell.2018.06.013.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.
Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004; 166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guedon et al., Current gene therapy using viral vectors for chronic pain. Mol Pain. May 13, 2015;11:27. doi: 10.1186/s12990-015-0018-1.
Gueneau et al., Structure of the MutLα C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.
Guerrette et al., The interaction of the human MutL homologues in hereditary nonpolyposis colon cancer. J Biol Chem. Mar. 5, 1999;274(10):6336-41. doi: 10.1074/jbc.274.10.6336.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Evolution of Tetrahymena ribozyme mutants with increased structural stability. Nat Struct Biol. Nov. 2002;9(11):855-61. doi: 10.1038/nsb850.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.
Guo et al., Structure of Cre recombinase complexed with DNA in a site-specific recombination synapse. Nature. Sep. 4, 1997;389(6646):40-6.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Mechanism of mismatch recognition revealed by human MutSβ bound to unpaired DNA loops. Nat Struct Mol Biol. Dec. 18, 2011;19(1):72-8. doi: 10.1038/nsmb.2175.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Haft et al., General mutagenesis of F plasmid TraI reveals its role in conjugative regulation. J Bacteriol. Sep. 2006;188(17):6346-53. doi: 10.1128/JB.00462-06.
Hagen et al., A high rate of polymerization during synthesis of mouse mammary tumor virus DNA alleviates hypermutation by

(56) References Cited

OTHER PUBLICATIONS

APOBEC3 proteins. PLoS Pathog. Feb. 15, 2019;15(2):e1007533. doi: 10.1371/journal.ppat.1007533.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibio18/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Hamilton et al., Targeted delivery of CRISPR-Cas9 and transgenes enables complex immune cell engineering. Cell Rep. Jun. 1, 2021;35(9):109207 and Suppl Info. doi: 10.1016/j.celrep.2021.109207.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanna et al., Massively parallel assessment of human variants with base editor screens. Cell. Feb. 18, 2021;184(4):1064-1080.e20. doi: 10.1016/j.cell.2021.01.012.
Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.
Hanson et al., Codon optimality, bias and usage in translation and mRNA decay. Nat Rev Mol Cell Biol. Jan. 2018; 19(1):20-30. doi: 10.1038/nrm.2017.91. Epub Oct. 11, 2017.
Hardt et al.,Missense variants in hMLH1 identified in patients from the German HNPCC consortium and functional studies. Fam Cancer. Jun. 2011;10(2):273-84. doi: 10.1007/s10689-011-9431-4.
Harms et al., Evolutionary biochemistry: revealing the historical and physical causes of protein properties. Nat Rev Genet. Aug. 2013;14(8):559-71. doi: 10.1038/nrg3540.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.
Harris et al., RNA Editing Enzyme APOBEC1 and Some of Its Homologs Can Act as DNA Mutators. Mol Cell. Nov. 2002;10(5):1247-53.
Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hartung et al., Cre mutants with altered DNA binding properties. J Biol Chem. Sep. 4, 1998;273(36):22884-91.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hashimoto et al., MitoTALEN: A General Approach to Reduce Mutant mtDNA Loads and Restore Oxidative Phosphorylation Function in Mitochondrial Diseases. Mol Ther. Oct. 2015;23(10):1592-9. doi: 10.1038/mt.2015.126. Epub Jul. 10, 2015.
Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hector et al., CDKL5 variants: Improving our understanding of a rare neurologic disorder. Neurol Genet. Dec. 15, 2017;3(6):e200. doi: 10.1212/NXG.0000000000000200.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.
Hendricks et al., The *S. cerevisiae* Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herschhorn et al., Retroviral reverse transcriptases. Cell Mol Life Sci. Aug. 2010;67(16):2717-47. doi: 10.1007/s00018-010-0346-2. Epub Apr. 1, 2010.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Heyer et al., Regulation of homologous recombination in eukaryotes. Annu Rev Genet. 2010;44:113-39. doi: 10.1146/annurev-genet-051710-150955. Author Manuscript. 33 pages.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

(56) References Cited

OTHER PUBLICATIONS

Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Hoang et al., UFBoot2: Improving the Ultrafast Bootstrap Approximation. Mol Biol Evol. Feb. 1, 2018;35(2):518-522. doi: 10.1093/molbev/msx281.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 27, 2016.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.
Hoogenboom et al., Natural and designer binding sites made by phage display technology. Immunol Today. Aug. 2000;21(8):371-8.
Horvath et al., CRISPR/Cas, the immune system of bacteria and archaea. Science. Jan. 8, 2010;327(5962):167-70. doi: 10.1126/science.1179555.
Horvath et al., Diversity, Activity, and Evolution of CRISPR Loci in Streptococcus Thermophilus. J Bacteriol. Feb. 2008;190(4):1401-12. doi: 10.1128/JB.01415-07. Epub Dec. 7, 2007.
Hotta et al., [Neurotropic viruses—classification, structure and characteristics]. Nihon Rinsho. Apr. 1997;55(4):777-82. Japanese.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houck-Loomis et al., An equilibrium-dependent retroviral mRNA switch regulates translational recoding. Nature. Nov. 27, 2011;480(7378):561-4. doi: 10.1038/nature10657.
Houdebine, The methods to generate transgenic animals and to control transgene expression. J Biotechnol. Sep. 25, 2002;98(2-3):145-60.
Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.
Houseley et al., The many pathways of RNA degradation. Cell. Feb. 20, 2009;136(4):763-76. doi: 10.1016/j.cell.2009.01.019.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.
Hsu et al., PrimeDesign software for rapid and simplified design of prime editing guide RNAs. Nat Commun. Feb. 15, 2021;12(1):1034. doi: 10.1038/s41467-021-21337-7.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Hua et al., Expanding the base editing scope in rice by using Cas9 variants. Plant Biotechnol J. Feb. 2019;17(2):499-504. doi: 10.1111/pbi.12993. Epub Oct. 5, 2018.
Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.
Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Huang et al., Heritable gene targeting in zebrafish using customized TALENs. Nat Biotechnol. Aug. 5, 2011;29(8):699-700. doi: 10.1038/nbt.1939.
Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.
Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.
Humbel et al., Maximizing lentiviral vector gene transfer in the CNS. Gene Ther. Feb. 2021;28(1-2):75-88. doi: 10.1038/s41434-020-0172-6. Epub Jul. 6, 2020. Erratum in: Gene Ther. May 2022;29(5):312.
Humbert et al., Targeted gene therapies: tools, applications, optimization. Crit Rev Biochem Mol Biol. May-Jun. 2012;47(3):264-81. doi: 10.3109/10409238.2012.658112.
Hung et al., Protein localization in disease and therapy. J Cell Sci. Oct. 15, 2011;124(Pt 20):3381-92. doi: 10.1242/jcs.089110.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Husimi, Selection and evolution of bacteriophages in cellstat. Adv Biophys. ; 1989;25:1-43. Review.

(56) References Cited

OTHER PUBLICATIONS

Hussman et al., Mapping the genetic landscape of DNA double-strand break repair. Cell. Oct. 28, 2021;184(22):5653-5669.e25. doi: 10.1016/j.cell.2021.10.002. Epub Oct. 20, 2021.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Hwang et al., Efficient In Vivo Genome Editing Using RNA-Guided Nucleases. Nat Biotechnol. Mar. 2013;31(3):227-229. doi: 10.1038/nbt.2501. Epub Jan. 29, 2013.
Hwang et al., Web-based design and analysis tools for CRISPR base editing. BMC Bioinformatics. Dec. 27, 2018;19(1):542. doi: 10.1186/s12859-018-2585-4.
Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9.2677.
Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.
Ibba et al., Substrate specificity is determined by amino acid binding pocket size in *Escherichia coli* phenylalanyl-tRNA synthetase. Biochemistry. Jun. 14, 1994;33(23):7107-12.
Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.
Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.
Iida et al., A site-specific, conservative recombination system carried by bacteriophage P1. Mapping the recombinase gene cin and the cross-over sites cix for the inversion of the C segment. EMBO J. 1982;1(11):1445-53.
Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.
Ikediobi et al., Mutation analysis of 24 known cancer genes in the NCI-60 cell line set. Mol Cancer Ther. Nov. 2006;5(11):2606-12. Epub Nov. 6, 2006.
Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.
Imburgio et al., Studies of promoter recognition and start site selection by T7 RNA polymerase using a comprehensive collection of promoter variants. Biochemistry. Aug. 29, 2000;39(34):10419-30.
Ingram, A specific chemical difference between the globins of normal human and sickle-cell anaemia haemoglobin. Nature. Oct. 13, 1956;178(4537):792-4. doi: 10.1038/178792a0.
Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Isaacs et al., Engineered riboregulators enable post-transcriptional control of gene expression. Nat Biotechnol. Jul. 2004;22(7):841-7. doi: 10.1038/nbt986. Epub Jun. 20, 2004.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Iwai et al., Circular beta-lactamase: stability enhancement by cyclizing the backbone. FEBS Lett. Oct. 8, 1999;459(2):166-72. doi: 10.1016/s0014-5793(99)01220-x.
Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.
Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.
Iyer et al., DNA mismatch repair: functions and mechanisms. Chem Rev. Feb. 2006;106(2):302-23. doi: 10.1021/cr0404794.
Iyer et al., Evolution of the deaminase fold and multiple origins of eukaryotic editing and mutagenic nucleic acid deaminases from bacterial toxin systems. Nucleic Acids Res. Dec. 2011;39(22):9473-97. doi: 10.1093/nar/gkr691. Epub Sep. 3, 2011.
Jaffrey et al., Emerging links between m6A and misregulated mRNA methylation in cancer. Genome Med. Jan. 12, 2017;9(1):2. doi: 10.1186/s13073-016-0395-8.
Jakimo et al., A Cas9 with Complete PAM Recognition for Adenine Dinucleotides. bioRxiv preprint. Sep. 27, 2018. doi.org/10.1101/429654. 29 pages.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.
Jasin et al., Repair of strand breaks by homologous recombination. Cold Spring Harb Perspect Biol. Nov. 1, 2013;5(11):a012740. doi: 10.1101/cshperspect.a012740.
Jeggo, DNA breakage and repair. Adv Genet. 1998;38:185-218. doi: 10.1016/s0065-2660(08)60144-3.
Jemielity et al., Novel "anti-reverse" cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Jiang et al., Chemical modifications of adenine base editor mRNA and guide RNA expand its application scope. Nat Commun. Apr. 24, 2020;11(1):1979. doi: 10.1038/s41467-020-15892-8.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

(56) References Cited

OTHER PUBLICATIONS

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jiricny, The multifaceted mismatch-repair system. Nat Rev Mol Cell Biol. May 2006;7(5):335-46. doi: 10.1038/nrm1907.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johansson et al., RNA Recognition by the MS2 Phage Coat Protein. Seminars in Virology. 1997;8(3):176-85. https://doi.org/10.1006/smvy.1997.0120.
Johansson et al., Selenocysteine in proteins-properties and biotechnological use. Biochim Biophys Acta. Oct. 30, 2005;1726(1):1-13. Epub Jun. 1, 2005.
Johns et al., The promise and peril of continuous in vitro evolution. J Mol Evol. Aug. 2005;61(2):253-63. Epub Jun. 27, 2005.
Johnson et al., Trans insertion-splicing: ribozyme-catalyzed insertion of targeted sequences into RNAs. Biochemistry. Aug. 9, 2005;44(31):10702-10. doi: 10.1021/bi0504815.
Joho et al., Identification of a region of the bacteriophage T3 and T7 RNA polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.
Jyothy et al., Translocation Down syndrome. Indian J Med Sci. Mar. 2002;56(3):122-6.
Kacian et al., Purification of the DNA polymerase of avian myeloblastosis virus. Biochim Biophys Acta. Sep. 24, 1971;246(3):365-83. doi: 10.1016/0005-2787(71)90773-8.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kadyrov et al., Endonucleolytic function of MutLalpha in human mismatch repair. Cell. Jul. 28, 2006;126(2):297-308. doi: 10.1016/j.cell.2006.05.039.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.
Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kavli et al., Excision of cytosine and thymine from DNA by mutants of human uracil-DNA glycosylase. EMBO J. Jul. 1, 1996;15(13):3442-7.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kay et al., Viral vectors for gene therapy: the art of turning infectious agents into vehicles of therapeutics. Nat Med. Jan. 2001;7(1):33-40.
Kaya et al., A bacterial Argonaute with noncanonical guide RNA specificity. Proc. Natl. Acad. Sci. USA Apr. 2016;113(15):4057-62.
Kazama et al., Curing cytoplasmic male sterility via TALEN-mediated mitochondrial genome editing. Nat Plants. Jul. 2019;5(7):722-730. doi: 10.1038/s41477-019-0459-z. Epub Jul. 8, 2019.
Keijzers et al., Human exonuclease 1 (EXO1) activity characterization and its function on flap structures. Biosci Rep. Apr. 25, 2015;35(3):e00206. doi: 10.1042/BSR20150058.

(56) References Cited

OTHER PUBLICATIONS

Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.
Kessel et al., Murine developmental control genes. Science. Jul. 27, 1990;249(4967):374-9. doi: 10.1126/science. 1974085.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

(56) References Cited

OTHER PUBLICATIONS

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.
Klug, The discovery of zinc fingers and their applications in gene regulation and genome manipulation. Annu Rev Biochem. 2010;79:213-31. doi: 10.1146/annurev-biochem-010909-095056.
Knott et al., CRISPR-Cas guides the future of genetic engineering. Science. Aug. 31, 2018;361(6405):866-869. doi: 10.1126/science.aat5011.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.
Koblan et al., Efficient CoG-to-GoC base editors developed using CRISPRi screens, target-library analysis, and machine learning. Nature Biotechnol. Jun. 28, 2021. https://doi.org/10.1038/s41587-021-00938-z.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 3, 20170;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krishnan et al., What causes mitochondrial DNA deletions in human cells? Nat Genet. Mar. 2008;40(3):275-9. doi: 10.1038/ng.f.94.
Krokan et al., Uracil in DNA—occurrence, consequences and repair. Oncogene. Dec. 16, 2002;21(58):8935-48. doi: 10.1038/sj.onc.1205996.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.

(56) References Cited

OTHER PUBLICATIONS

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.
Kuan et al., A systematic evaluation of nucleotide properties for CRISPR sgRNA design. BMC Bioinformatics. Jun. 6, 2017;18(1):297. doi: 10.1186/s12859-017-1697-6.
Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Kumar et al., Gene therapy for chronic neuropathic pain: how does it work and where do we stand today? Pain Med. May 2011;12(5):808-22. doi: 10.1111/j.1526-4637.2011.01120.x.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunkel et al., DNA mismatch repair. Annu Rev Biochem. 2005;74:681-710. doi: 10.1146/annurev.biochem.74.082803.133243.
Kunkel et al., Eukaryotic Mismatch Repair in Relation to DNA Replication. Annu Rev Genet. 2015;49:291-313. doi: 10.1146/annurev-genet-112414-054722.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017; 14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using Correct. Nat Protoc. Feb. 2017;12(2):329-354. doi: 10.1038/nprot.2016.171. Epub Jan. 19, 2017.
Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.
Kwon et al., Chemical basis of glycine riboswitch cooperativity. RNA. Jan. 2008;14(1):25-34. Epub Nov. 27, 2007.
Lada et al., Mutator effects and mutation signatures of editing deaminases produced in bacteria and yeast. Biochemistry (Mosc). Jan. 2011;76(1):131-46.
Lahue et al., DNA mismatch correction in a defined system. Science. Jul. 14, 1989;245(4914):160-4. doi: 10.1126/science.2665076.
Lakich et al., Inversions disrupting the factor VIII gene are a common cause of severe haemophilia A. Nat Genet. Nov. 1993;5(3):236-41. doi: 10.1038/ng1193-236.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Landrum et al., Clin Var: public archive of interpretations of clinically relevant variants. Nucleic Acids Res. Jan. 4, 2016;44(D1):D862-8. doi: 10.1093/nar/gkv1222. Epub Nov. 17, 2015.
Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., Chemical and Physical Structure of Polymers as Carriers for Controlled Release of Bioactive Agents: A Review. J Macromol Sci, Part C, 1983;23(1):61-126. doi: 10.1080/07366578308079439.
Langer et al., New methods of drug delivery. Science. Sep. 28, 1990;249(4976):1527-33.
Lapinaite et al., DNA capture by a CRISPR-Cas9-guided adenine base editor. Science. Jul. 31, 2020;369(6503):566-571. doi: 10.1126/science.abb1390.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lauritzen et al., Mitochondrial DNA toxicity in forebrain neurons causes apoptosis, neurodegeneration, and impaired behavior. Mol Cell Biol. Mar. 2010;30(6):1357-67. doi: 10.1128/MCB.01149-09. Epub Jan. 11, 2010.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5): 1055-1067. doi: 10.1099/13500872-145-5-1055.
Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leach et al., Mutations of a mutS homolog in hereditary nonpolyposis colorectal cancer. Cell. Dec. 17, 1993;75(6):1215-25. doi: 10.1016/0092-8674(93)90330-s.
Leaver-Fay et al., ROSETTA3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on

(56) References Cited

OTHER PUBLICATIONS evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Lee et al., Simultaneous targeting of linked loci in mouse embryos using base editing. Sci Rep. Feb. 7, 2019;9(1):1662. doi: 10.1038/s41598-018-33533-5.

Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773. 13 pages.

Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773.

Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lee et al., Transcriptional regulation and its misregulation in disease. Cell. Mar. 14, 2013;152(6):1237-51. doi: 10.1016/j.cell.2013.02.014.

Lefebvre et al., Identification and characterization of a spinal muscular atrophy-determining gene. Cell. Jan. 13, 1995;80(1):155-65. doi: 10.1016/0092-8674(95)90460-3.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lei et al., Site-specificity of serine integrase demonstrated by the attB sequence preference of QBT1 integrase. FEBS Lett. Apr. 2018;592(8):1389-1399. doi: 10.1002/1873-3468.13023. Epub Mar. 25, 2018.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.

Levy et al., Inhibition of calcification of bioprosthetic heart valves by local controlled-release diphosphonate. Science. Apr. 12, 1985;228(4696):190-2.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Building the Class 2 CRISPR-Cas Arsenal. Mol Cell 2017;65(3);377-379.

Lewis et al., Codon 129 polymorphism of the human prion protein influences the kinetics of amyloid formation. J Gen Virol. Aug. 2006;87(Pt 8):2443-9.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Current approaches for engineering proteins with diverse biological properties. Adv Exp Med Biol. 2007;620:18-33.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

(56) References Cited

OTHER PUBLICATIONS

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Loss of post-translational modification sites in disease. Pac Symp Biocomput. 2010:337-47. doi: 10.1142/9789814295291_0036.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Li, Mechanisms and functions of DNA mismatch repair. Cell Res. Jan. 2008;18(1):85-98. doi: 10.1038/cr.2007.115.
Liang et al., Correction of β-thalassemia mutant by base editor in human embryos. Protein Cell. Nov. 2017;8(11):811-822. doi: 10.1007/s13238-017-0475-6. Epub Sep. 23, 2017.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Liao et al., One-step assembly of large CRISPR arrays enables multi-functional targeting and reveals constraints on array design. bioRxiv. May 2, 2018. doi: 10.1101/312421. 45 pages.
Lieber et al., Mechanism and regulation of human non-homologous DNA end-joining. Nat Rev Mol Cell Biol. Sep. 2003;4(9):712-20.
Liefke et al., The oxidative demethylase ALKBH3 marks hyperactive gene promoters in human cancer cells. Genome Med. Jun. 30, 2015;7(1):66. doi: 10.1186/s13073-015-0180-0.
Lienert et al., Two- and three-input TALE-based and logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., [Construction and evaluation of DnaB split intein high expression vector and a six amino acids cyclic peptide library]. Sheng Wu Gong Cheng Xue Bao. Nov. 2008;24(11):1924-30. Chinese.
Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.
Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.
Lin et al., Prime genome editing in rice and wheat. Nat Biotechnol. May 2020;38(5):582-585. doi: 10.1038/s41587-020-0455-x. Epub Mar. 16, 2020.
Lin et al., SAPTA: a new design tool for improving TALE nuclease activity. Nucleic Acids Res. Apr. 2014;42(6):e47. doi: 10.1093/nar/gkt1363. Epub Jan. 16, 2014.
Lin et al., The human REV1 gene codes for a DNA template-dependent dCMP transferase. Nucleic Acids Res. Nov. 15, 1999;27(22):4468-75. doi: 10.1093/nar/27.22.4468.
Lindahl, T., Instability and decay of the primary structure of DNA. Nature. Apr. 22, 1993;362(6422):709-15. doi: 10.1038/362709a0.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., (6)-methyladenosine-dependent RNA structural switches regulate RNA-protein interactions. Nature. Feb. 26, 2015;518(7540):560-4. doi: 10.1038/nature14234.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.
Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.

(56) References Cited

OTHER PUBLICATIONS

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Liu et al., Fast Colorimetric Sensing of Adenosine and Cocaine Based on a General Sensor Design Involving Aptamers and Nanoparticles. Angew Chem. 2006;118(1):96-100.

Liu et al., Flap endonuclease 1: a central component of DNA metabolism. Annu Rev Biochem. 2004;73:589-615. doi:10.1146/annurev.biochem.73.012803.092453.

Liu et al., Functional Nucleic Acid Sensors. Chem Rev. May 2009;109(5):1948-98. doi: 10.1021/cr030183i.

Liu et al., Genetic incorporation of unnatural amino acids into proteins in mammalian cells. Nat Methods. Mar. 2007;4(3):239-44. Epub Feb. 25, 2007.

Liu et al., Highly efficient RNA-guided base editing in rabbit. Nat Commun. Jul. 13, 2018;9(1):2717. doi: 10.1038/s41467-018-05232-2.

Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.

Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Longsworth, Expanding the Enzymatic Activity of the Programmable Endonuclease Cas9 in Zebrafish. Thesis. Rice University. Houston, TX. May 17, 2019. 41 pages.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Losey et al., Crystal structure of *Staphylococcus sureus* tRNA adenosine deaminase tadA in complex with RNA. Nature Struct. Mol. Biol. Feb. 2006;13(2):153-9.

Lott et al., mtDNA Variation and Analysis Using Mitomap and Mitomaster. Curr Protoc Bioinformatics. Dec. 2013;44(123):1.23.1-26. doi: 10.1002/0471250953.bi0123s44.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Luke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.

Lynch, Evolution of the mutation rate. Trends Genet. Aug. 2010;26(8):345-52. doi: 10.1016/j.tig.2010.05.003. Epub Jun. 30, 2010.

Lyons et al., Efficient Recognition of an Unpaired Lesion by a DNA Repair Glycosylase. J. Am. Chem. Soc., 2009;131(49):17742-3. DOI: 10.1021/ja908378y.

Lyu et al., Virus-Like Particle Mediated CRISPR/Cas9 Delivery for Efficient and Safe Genome Editing. Life (Basel). Dec. 21, 2020;10(12):366. doi: 10.3390/life10120366.

Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

(56) References Cited

OTHER PUBLICATIONS

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Ma et al., Targeted AID-mediated mutagenesis (TAM) enables efficient genomic diversification in mammalian cells. Nature Methods. Oct. 2016;13:1029-35. doi:10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
MacBeth et al., Inositol hexakisphosphate is bound in the ADAR2 core and required for RNA editing. Science. Sep. 2, 2005;309(5740):1534-9. doi: 10.1126/science.1113150.
MacFadden et al., Mechanism and structural diversity of exoribonuclease-resistant RNA structures in flaviviral RNAs. Nat Commun. Jan. 9, 2018;9(1):119. doi: 10.1038/s41467-017-02604-y.
MaCrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.
Magin et al., Corf, the Rev/Rex homologue of HTDV/HERV-K, encodes an arginine-rich nuclear localization signal that exerts a trans-dominant phenotype when mutated. Virology. Aug. 1, 20005;274(1): 11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? CRISPR J. Oct. 2018; 1(5):325-336. doi: 10.1089/crispr.2018.0033.
Makarova et al., Evolution and classification of the CRISPR-Cas systems. Nat Rev Microbiol. Jun. 2011;9(6):467-77. doi: 10.1038/nrmicro2577. Epub May 9, 2011.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Makeyev et al., Evolutionary potential of an RNA virus. J Virol. Feb. 2004;78(4):2114-20.
Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).
Mali et al., Cas9 as a versatile tool for engineeringbiology. Nat Methods. Oct. 2013; 10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.
Marraffini et al., CRISPR interference limits horizontal gene transfer in staphylococci by targeting DNA. Science. Dec. 19, 2008;322(5909):1843-5. doi: 10.1126/science.1165771.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Martz, L., Nav-i-gating antibodies for pain. Science-Business eXchange. Jun. 12, 2014;7(662):1-2. doi: 10.1038/scibx.2014.662.

(56) References Cited

OTHER PUBLICATIONS

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Marzec et al., Prime Editing: A New Way for Genome Editing. Trends Cell Biol. Apr. 2020;30(4):257-259. doi: 10.1016/j.tcb.2020.01.004. Epub Jan. 27, 2020.

Mascola et al., HIV-1 neutralizing antibodies: understanding nature's pathways. Immunol Rev. Jul. 2013;254(1):225-44. doi: 10.1111/imr.12075.

Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.

Mathys et al., Characterization of a self-splicing mini-intein and its conversion into autocatalytic - and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

McInerney et al., Error Rate Comparison during Polymerase Chain Reaction by DNA Polymerase. Mol Biol Int. 2014;2014:287430. doi: 10.1155/2014/287430. Epub Aug. 17, 2014.

McKenna et al., Recording development with single cell dynamic lineage tracing. Development. Jun. 27, 2019;146(12):dev169730. doi: 10.1242/dev.169730.

McKenna et al., Whole-organism lineage tracing by combinatorial and cumulative genome editing. Science. Jul. 29, 2016;353(6298):aaf7907. doi: 10.1126/science.aaf7907. Epub May 26, 2016.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. N Engl J Med. Nov. 19, 2009;361(21):2056-65. doi: 10.1056/NEJMoa0809716.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.

Mendell et al., Single-Dose Gene-Replacement Therapy for Spinal Muscular Atrophy. N Engl J Med. Nov. 2, 2017;377(18):1713-1722. doi: 10.1056/NEJMoa1706198.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Mertens et al., Site-specific recombination in bacteriophage Mu: characterization of binding sites for the DNA invertase Gin. EMBO J. Apr. 1988;7(4):1219-27.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Confirmation of a second natural preQ1 aptamer class in *Streptococcaceae bacteria*. RNA. Apr. 2008;14(4):685-95. doi: 10.1261/rna.937308. Epub Feb. 27, 2008.

Meyer et al., Library generation by gene shuffling. Curr Protoc Mol Biol. Jan. 6, 2014;105: Unit 15.12.. doi: 10.1002/0471142727.mb1512s105.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Miller, Human gene therapy comes of age. Nature. Jun. 11, 1992;357(6378):455-60. doi: 10.1038/357455a0.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Min et al., Deep learning in bioinformatics. Brief Bioinform. Sep. 1, 2017;18(5):851-869. doi: 10.1093/bib/bbw068.

(56) References Cited

OTHER PUBLICATIONS

Minczuk et al., Development of a single-chain, quasi-dimeric zinc-finger nuclease for the selective degradation of mutated human mitochondrial DNA. Nucleic Acids Res. Jul. 2008;36(12):3926-38. doi: 10.1093/nar/gkn313. Epub May 29, 2008.
Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mir et al., Two Active Site Divalent Ions in the Crystal Structure of the Hammerhead Ribozyme Bound to a Transition State Analogue. Biochemistry . . . Feb. 2, 2016;55(4):633-6. doi: 10.1021/acs.biochem.5b01139. Epub Jan. 19, 2016.
Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitani et al., Delivering therapeutic genes—matching approach and application. Trends Biotechnol. May 1993;11(5):162-6. doi: 10.1016/0167-7799(93)90108-L.
Mitton-Fry et al., Poly(A) tail recognition by a viral RNA element through assembly of a triple helix. Science. Nov. 26, 2010;330(6008):1244-7. doi: 10.1126/science.1195858.
Miyaoka et al., Systematic quantification of HDR and NHEJ reveals effects of locus, nuclease, and cell type on genome-editing. Sci Rep. Mar. 31, 2016;6:23549. doi: 10.1038/srep23549.
Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mojica et al., Intervening sequences of regularly spaced prokaryotic repeats derive from foreign genetic elements. J Mol Evol. Feb. 2005;60(2):174-82.
Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.
Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.
Mol et al., Crystal structure of human uracil-DNA glycosylase in complex with a protein inhibitor: protein mimicry of DNA. Cell. Sep. 8, 1995;82(5):701-8.
Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.
Monahan et al., Site-specific incorporation of unnatural amino acids into receptors expressed in Mammalian cells. Chem Biol. Jun. 2003;10(6):573-80.
Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.
Monot et al., The specificity and flexibility of 11 reverse transcription priming at imperfect T-tracts. PLoS Genet. May 2013;9(5):e1003499. doi: 10.1371/journal.pgen.1003499. Epub May 9, 2013.
Montange et al., Structure of the S-adenosylmethionine riboswitch regulatory mRNA element. Nature. Jun. 29, 2006;441(7097):1172-5.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5 and Supporting Information. doi: 10.1021/ja0267690. 4 pages.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Moretton et al., Selective mitochondrial DNA degradation following double-strand breaks. PLoS One. Apr. 28, 2017;12(4):e0176795. doi: 10.1371/journal.pone.0176795.
Morita et al., The site-specific recombination system of actinophage TG1. Fems Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mougiakos et al., Characterizing a thermostable Cas9 for bacterial genome editing and silencing. Nat Commun. Nov. 21, 2017;8(1):1647. doi: 10.1038/s41467-017-01591-4.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (Next) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Muller, U.F., Design and Experimental Evolution of trans-Splicing Group I Intron Ribozymes. Molecules. Jan. 2, 2017;22(1):75. doi: 10.3390/molecules22010075.
Mullins et al., Transgenesis in nonmurine species. Hypertension. Oct. 1993;22(4):630-3.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Murphy, Phage recombinases and their applications. Adv Virus Res. 2012;83:367-414. doi: 10.1016/B978-0-12-394438-2.00008-6. Review.
Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.
Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

(56) References Cited

OTHER PUBLICATIONS

Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Neel et al., Riboswitches: Classification, function and in silico approach, International Journal of Pharma Sciences and Research. 2010;1(9):409-420.
Nelson et al., Engineered pegRNAs improve prime editing efficiency. Nat Biotechnol. Oct. 4, 2021. doi: 10.1038/s41587-021-01039-7. Epub ahead of print. Erratum in: Nat Biotechnol. Dec. 8, 2021. 14 pages.
Nelson et al., Filamentous phage DNA cloning vectors: a noninfective mutant with a nonpolar deletion in gene III. Virology. 1981; 108(2): 338-50.
Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.
Nelson et al., The unstable repeats—three evolving faces of neurological disease. Neuron. Mar. 6, 2013;77(5):825-43. doi: 10.1016/j.neuron.2013.02.022.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Newby et al., Base editing of haematopoietic stem cells rescues sickle cell disease in mice. Nature. Jun. 2, 2021. doi: 10.1038/s41586-021-03609-w. Epub ahead of print.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of *Staphylococcus aureus* Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nissanka et al., The mitochondrial DNA polymerase gamma degrades linear DNA fragments precluding the formation of deletions. Nat Commun. Jun. 27, 2018;9(1):2491. doi: 10.1038/s41467-018-04895-1.
Noack et al., Epitranscriptomics: A New Regulatory Mechanism of Brain Development and Function. Front Neurosci. Feb. 20, 2018;12:85. doi: 10.3389/fnins.2018.00085. 9 pages.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Oakes et al., Protein engineering of Cas9 for enhanced function. Methods Enzymol. 2014;546:491-511.
O'Connell et al., Programmable RNA recognition and cleavage by CRISPR/Cas9. Nature. Dec. 11, 2014;516(7530):263-6. doi: 10.1038/nature13769. Epub Sep. 28, 2014.

(56) References Cited

OTHER PUBLICATIONS

Odsbu et al., Specific N-terminal interactions of the *Escherichia coli* SeqA protein are required to form multimers that restrain negative supercoils and form foci. Genes Cells. Nov. 2005;10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Offord, Advances in Genome Editing. The Scientist, Apr. 20, 2016. http://www.the-scientist.com/?articles.view/articleNo/45903/title/Advances-in-Genome-Editing/.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from *Streptomyces cyanogenus*. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
O'Maille et al., Structure-based combinatorial protein engineering (Scope). J Mol Biol. Aug. 23, 2002;321(4):677-91.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Osborn et al., TALEN-based gene correction for epidermolysis bullosa. Mol Ther. Jun. 2013;21(6):1151-9. doi: 10.1038/mt.2013.56. Epub Apr. 2, 2013.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Ottesen, ISS-N1 makes the First FDA-approved Drug for Spinal Muscular Atrophy. Transl Neurosci. Jan. 26, 2017;8:1-6. doi: 10.1515/tnsci-2017-0001.
Otto et al., The probability of fixation in populations of changing size. Genetics. Jun. 1997;146(2):723-33.
Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi:10.1126/science.1207339.
Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Pan et al., Biological and biomedical applications of engineered nucleases. Mol Biotechnol. Sep. 2013;55(1):54-62. doi: 10.1007/s12033-012-9613-9.
Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Parente et al., Advances in spinal muscular atrophy therapeutics. Ther Adv Neurol Disord. Feb. 5, 2018;11:1756285618754501. doi: 10.1177/1756285618754501. 13 pages.
Park et al., Digenome-seq web tool for profiling CRISPR specificity. Nat Methods. May 30, 2017;14(6):548-549. doi: 10.1038/nmeth.4262.
Park et al., Highly efficient editing of the β-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Parsons et al., Hypermutability and mismatch repair deficiency in RER+ tumor cells. Cell. Dec. 17, 1993;75(6):1227-36. doi: 10.1016/0092-8674(93)90331-j.
Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genome-editing enzymes. Methods Enzymol. 2014;546:47-78. doi: 10.1016/B978-0-12-801185-0.00003- 9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.

(56) References Cited

OTHER PUBLICATIONS

Peeva et al., Linear mitochondrial DNA is rapidly degraded by components of the replication machinery. Nat Commun. Apr. 30, 2018;9(1):1727. doi: 10.1038/s41467-018-04131-w.
Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.
Pendse et al., In Vivo Assessment of Potential Therapeutic Approaches for USH2A-Associated Diseases. Adv Exp Med Biol. 2019;1185:91-96. doi: 10.1007/978-3-030-27378-1_15.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Pereira et al., mitoTev-TALE: a monomeric DNA editing enzyme to reduce mutant mitochondrial DNA levels. EMBO Mol Med. Sep. 2018;10(9):e8084. doi: 10.15252/emmm.201708084.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Perreault et al., Mixed deoxyribo- and ribo-oligonucleotides with catalytic activity. Nature. Apr. 5, 1990;344(6266):565-7. doi: 10.1038/344565a0.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petit et al., Powerful mutators lurking in the genome. Philos Trans R Soc Lond B Biol Sci. Mar. 12, 2009;364(1517):705-15. doi: 10.1098/rstb.2008.0272.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Phillips, The challenge of gene therapy and DNA delivery. J Pharm Pharmacol. Sep. 2001;53(9):1169-74.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pieken et al., Kinetic characterization of ribonuclease-resistant 2'-modified hammerhead ribozymes. Science. Jul. 19, 1991;253(5017):314-7. doi: 10.1126/science.1857967.
Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.
Pluciennik et al., PCNA function in the activation and strand direction of MutLa endonuclease in mismatch repair. Proc Natl Acad Sci U S A. Sep. 14, 2010;107(37):16066-71. doi: 10.1073/pnas.1010662107. Epub Aug. 16, 2010.
Podracky et al., Laboratory evolution of a sortase enzyme that modifies amyloid-β protein. Nat Chem Biol. Mar. 2021;17(3):317-325. doi: 10.1038/s41589-020-00706-1. Epub Jan. 11, 2021.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

(56) References Cited

OTHER PUBLICATIONS

Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Pruschy et al., Mechanistic studies of a signaling pathway activated by the organic dimerizer FK1012. Chem Biol. Nov. 1994;1(3):163-72. doi: 10.1016/1074-5521(94)90006-x.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.
Raillard et al., Targeting sites within HIV-1 cDNA with a DNA-cleaving ribozyme. Biochemistry. Sep. 10, 1996;35(36):11693-701. doi: 10.1021/bi960845g.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Rajagopal et al., High-throughput mapping of regulatory DNA. Nat Biotechnol. Feb. 2016;34(2):167-74. doi: 10.1038/nbt.3468. Epub Jan. 25, 2016.
Rakonjac et al., Roles of PIII in filamentous phage assembly. J Mol Biol. 1998; 282(1)25-41.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramamurthy et al., Identification of immunogenic B-cell epitope peptides of rubella virus E1 glycoprotein towards development of highly specific immunoassays and/or vaccine. Conference Abstract. 2019.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ramos et al., Age-dependent SMN expression in disease-relevant tissue and implications for SMA treatment. J Clin Invest. Nov. 1, 2019;129(11):4817-4831. doi: 10.1172/JCI124120.
Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.
Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rath et al., Fidelity of end joining in mammalian episomes and the impact of Metnase on joint processing. BMC Mol Biol. Mar. 22, 2014;15:6. doi: 10.1186/1471-2199-15-6.
Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Ray et al., A compendium of RNA-binding motifs for decoding gene regulation. Nature. Jul. 11, 2013;499(7457):172-7. doi: 10.1038/nature12311.
Ray et al., Homologous recombination: ends as the means. Trends Plant Sci. Oct. 2002;7(10):435-40.
Rebar et al., Phage display methods for selecting zinc finger proteins with novel DNA-binding specificities. Methods Enzymol. 1996;267:129-49.
Rebuzzini et al., New mammalian cellular systems to study mutations introduced at the break site by non-homologous end-joining. DNA Repair (Amst). May 2, 2005;4(5):546-55.
Reddy et al., Selective elimination of mitochondrial mutations in the germline by genome editing. Cell. Apr. 23, 2015;161(3):459-469. doi: 10.1016/j.cell.2015.03.051.

(56) References Cited

OTHER PUBLICATIONS

Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Rees et al., Improving the DNA specificity and applicability of base editing through protein engineering and protein delivery. Nat Commun. Jun. 6, 2017;8:15790. doi: 10.1038/ncomms15790.
Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.
Relph et al., Recent developments and current status of gene therapy using viral vectors in the United Kingdom. BMJ. 2004;329(7470):839-842. doi:10.1136/bmj.329.7470.839.
Remy et al., Gene transfer with a series of lipophilic DNA-binding molecules. Bioconjug Chem. Nov.-Dec. 1994;5(6):647-54. doi: 10.1021/bc00030a021.
Ren et al., In-line Alignment and $Mg^{2+}$ Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., FLASH assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richardson et al., Frequent chromosomal translocations induced by DNA double-strand breaks. Nature. Jun. 8, 2000;405(6787):697-700. doi: 10.1038/35015097.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Riechmann et al., The C-terminal domain of To1A is the coreceptor for filamentous phage infection of *E. coli*. Cell. 1997; 90(2):351-60. PMID:9244308.
Rinaldi et al., The effect of increasing numbers of repeats on TAL effector DNA binding specificity. Nucleic Acids Res. Jun. 20, 2017;45(11):6960-6970. doi: 10.1093/nar/gkx342.
Ringrose et al., The Kw recombinase, an integrase from Kluyveromyces waltii. Eur J Biochem. Sep. 15, 1997;248(3):903-12. doi: 10.1111/j.1432-1033.1997.00903.x.
Risso et al., Hyperstability and substrate promiscuity in laboratory resurrections of Precambrian B-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Rivoltini et al., A superagonist variant of peptide MART1/Melan A27-35 elicits anti-melanoma CD8+ T cells with enhanced functional characteristics: implication for more effective immunotherapy. Cancer Res. Jan. 15, 1999;59(2):301-6. 18 pages.
Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.
Robertson et al., DNA repair in mammalian cells: Base excision repair: the long and short of it. Cell Mol Life Sci. Mar. 2009;66(6):981-93. doi: 10.1007/s00018-009-8736-z.
Robertson et al., Selection in vitro of an RNA enzyme that specifically cleaves single-stranded DNA. Nature. Mar. 29, 1990;344(6265):467-8. doi: 10.1038/344467a0.
Robinson et al., The protein tyrosine kinase family of the human genome. Oncogene. Nov. 20, 2000;19(49):5548-57. doi: 10.1038/sj.onc.1203957.
Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.
Rogers et al., Context influences on TALE-DNA binding revealed by quantitative profiling. Nat Commun. Jun. 11, 2015;6:7440. doi: 10.1038/ncomms8440.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.

(56) References Cited

OTHER PUBLICATIONS

Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rüfer et al., Non-contact positions impose site selectivity on Cre recombinase. Nucleic Acids Res. Jul. 1, 2002;30(13):2764-71. doi: 10.1093/nar/gkf399.
Ruiz-Pesini et al., An enhanced MITOMAP with a global mtDNA mutational phylogeny. Nucleic Acids Res. Jan. 2007;35(Database issue):D823-8. doi: 10.1093/nar/gk1927. Epub Dec. 18, 2006.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Ryzhkova et al., Mitochondrial diseases caused by mtDNA mutations: a mini-review. Ther Clin Risk Manag. Oct. 9, 2018;14:1933-1942. doi: 10.2147/TCRM.S154863.
Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of *Saccharomyces cerevisiae*. Prog Nucleic Acid Res Mol Biol. 1995;51:53-91.
Safari et al., CRISPR Cpf1 proteins: structure, function and implications for genome editing. Cell Biosci. May 9, 2019;9:36. doi: 10.1186/s13578-019-0298-7.
Sage et al., Proliferation of functional hair cells in vivo in the absence of the retinoblastoma protein. Science. Feb. 18, 2005;307(5712):1114-8. Epub Jan. 13, 2005.
Saha et al., The NIH Somatic Cell Genome Editing program. Nature. Apr. 2021;592(7853):195-204. doi: 10.1038/s41586-021-03191-1. Epub Apr. 7, 2021.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samanta et al., A reverse transcriptase ribozyme. Elife. Sep. 26, 2017;6:e31153. doi: 10.7554/eLife.31153.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
San Filippo et al., Mechanism of eukaryotic homologous recombination. Annu Rev Biochem. 2008;77:229-57. doi: 10.1146/annurev.biochem.77.061306.125255.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Satomura et al., Precise genome-wide base editing by the CRISPR Nickase system in yeast. Sci Rep. May 18, 2017;7(1):2095. doi: 10.1038/s41598-017-02013-7.
Saudek et al., A preliminary trial of the programmable implantable medication system for insulin delivery. Engl J Med. Aug. 31, 1989;321(9):574-9.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Savva et al., The structural basis of specific base-excision repair by uracil-DNA glycosylase. Nature. Feb. 9, 1995;373(6514):487-93. doi: 10.1038/373487a0.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

(56) References Cited

OTHER PUBLICATIONS

Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR- Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Schon et al., Mitochondria: the next (neurode)generation. Neuron. Jun. 23, 2011;70(6):1033-53. doi: 10.1016/j.neuron.2011.06.003.
Schrank et al., Inactivation of the survival motor neuron gene, a candidate gene for human spinal muscular atrophy, leads to massive cell death in early mouse embryos. Proc Natl Acad Sci U S A. Sep. 2, 1997;94(18):9920-5. doi: 10.1073/pnas.94.18.9920.
Schriefer et al., Low pressure DNA shearing: a method for random DNA sequence analysis. Nucleic Acids Res. Dec. 25, 1990;18(24):7455-6.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3' -- >P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for Shimomura et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.
Scott et al., Production of cyclic peptides and proteins in vivo. Proc Natl Acad Sci U S A. Nov. 23, 1999;96(24):13638-43. doi: 10.1073/pnas.96.24.13638.
Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019;18(6):421-446. doi: 10.1038/s41573-019-0017-4.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shaikh et al., Chimeras of the Flp and Cre recombinases: tests of the mode of cleavage by Flp and Cre. J Mol Biol. Sep. 8, 2000;302(1):27-48.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.

(56) References Cited

OTHER PUBLICATIONS

Sharma et al., Efficient introduction of aryl bromide functionality into proteins in vivo. FEBS Lett. Feb. 4, 2000;467(1):37-40.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.
Shee et al., Engineered proteins detect spontaneous DNA breakage in human and bacterial cells. Elife. Oct. 29, 2013;2:e01222. doi: 10.7554/eLife.01222.
Shen et al., Efficient genome modification by CRISPR-Cas9 nickase with minimal off-target effects. Nat Methods. Apr. 2014; 11(4):399-402. doi: 10.1038/nmeth.2857. Epub Mar. 2, 2014.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Silverman et al., Haemolysin coregulated protein is an exported receptor and chaperone of type VI secretion substrates. Mol Cell. Sep. 12, 2013;51(5):584-93. doi: 10.1016/j.molcel.2013.07.025. Epub Aug. 15, 2013.
Simonelli et al., Base excision repair intermediates are mutagenic in mammalian cells. Nucleic Acids Res. Aug. 2, 2005;33(14):4404-11. Print 2005.
Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sjoblom et al., The consensus coding sequences of human breast and colorectal cancers. Science. Oct. 13, 2006;314(5797):268-74. Epub Sep. 7, 2006.
Skretas et al., Regulation of protein activity with small-molecule-controlled inteins. Protein Sci. Feb. 2005;14(2):523-32. Epub Jan. 4, 2005.
Slaymaker et al., Rationally engineered Cas9 nucleases with improved specificity. Science. Jan. 1, 2016;351(6268):84-8. doi: 10.1126/science.aad5227. Epub Dec. 1, 2015.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Diversity in the serine recombinases. Mol Microbiol. Apr. 2002;44(2):299-307. Review.

(56) References Cited

OTHER PUBLICATIONS

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Sommerfelt et al., Receptor interference groups of 20 retroviruses plating on human cells. Virology. May 1990;176(1):58-69. doi: 10.1016/0042-6822(90)90230-o.
Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.
Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.
Song et al., RS-1 enhances CRISPR/Cas9- and TALEN-mediated knock-in efficiency. Nat Commun. Jan. 28, 2016;7:10548. doi: 10.1038/ncomms10548.
Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Steiner et al., The neurotropic herpes viruses: herpes simplex and varicella-zoster. Lancet Neurol. Nov. 2007;6(11):1015-28. doi: 10.1016/S1474-4422(07)70267-3.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Stephens et al., The landscape of cancer genes and mutational processes in breast cancer. Nature Jun. 2012;486:400-404. doi: 10.1038/nature11017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Sterne-Weiler et al., Exon identity crisis: disease-causing mutations that disrupt the splicing code. Genome Biol. Jan. 23, 2014;15(1):201. doi: 10.1186/gb4150.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Stover et al., Complete genome sequence of Pseudomonas aeruginosa PAO1, an opportunistic pathogen. Nature. Aug. 31, 2000;406(6799):959-64. doi: 10.1038/35023079.
Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.
Strecker et al., Engineering of CRISPR-Cas12b for human genome editing. Nat Commun. Jan. 22, 2019;10(1):212. doi: 10.1038/s41467-018-08224-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Stuart et al., DNA base excision repair activities and pathway function in mitochondrial and cellular lysates from cells lacking mitochondrial DNA. Nucleic Acids Res. Apr. 23, 2004;32(7):2181-92. doi: 10.1093/nar/gkh533.
Su et al., Human DNA polymerase n has reverse transcriptase activity in cellular environments. J Biol Chem. Apr. 12, 2019;294(15):6073-6081. doi: 10.1074/jbc.RA119.007925. Epub Mar. 6, 2019.
Su et al., Mispair specificity of methyl-directed DNA mismatch correction in vitro. J Biol Chem. May 15, 1988;263(14):6829-35. Erratum in: J Biol Chem Aug. 5, 1988;263(22):11015.
Sudarsan et al., An mRNA structure in bacteria that controls gene expression by binding lysine. Genes Dev. Nov. 1, 2003;17(21):2688-97.

(56) References Cited

OTHER PUBLICATIONS

Sudarsan et al., Riboswitches in eubacteria sense the second messenger cyclic di-GMP. Science. Jul. 18, 2008;321(5887):411-3. doi: 10.1126/science.1159519.
Suess et al., A theophylline responsive riboswitch based on helix slipping controls gene expression in vivo. Nucleic Acids Res. Mar. 5, 2004;32(4):1610-4.
Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sullenger et al., Ribozyme-mediated repair of defective mRNA by targeted, trans-splicing. Nature. Oct. 13, 1994;371(6498):619-22. doi: 10.1038/371619a0.
Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Supek et al., Differential DNA mismatch repair underlies mutation rate variation across the human genome. Nature. May 7, 2015;521(7550):81-4. doi: 10.1038/nature14173. Epub Feb. 23, 2015.
Surun et al., High Efficiency Gene Correction in Hematopoietic Cells by Donor-Template- Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Svitashev et al., Targeted Mutagenesis, Precise Gene Editing, and Site-Specific Gene Insertion in Maize Using Cas9 and Guide RNA. Plant Physiol. Oct. 2015;169(2):931-45. doi: 10.1104/pp.15.00793. Epub Aug. 12, 2015.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Talbot et al., Spinal muscular atrophy. Semin Neurol. Jun. 2001;21(2):189-97. doi: 10.1055/s-2001-15264.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thomas et al., Heteroduplex repair in extracts of human HeLa cells. J Biol Chem. Feb. 25, 1991;266(6):3744-51.
Thompson et al., Cellular uptake mechanisms and endosomal trafficking of supercharged proteins. Chem Biol. Jul. 27, 2012;19(7):831-43. doi: 10.1016/j.chembiol.2012.06.014.

(56) References Cited

OTHER PUBLICATIONS

Thompson et al., Engineering and identifying supercharged proteins for macromolecule delivery into mammalian cells. Methods Enzymol. 2012;503:293-319. doi: 10.1016/B978-0-12396962-0.00012-4.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.
Tone et al., Single-stranded DNA binding protein Gp5 of Bacillus subtilis phage Φ29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 22, 2009.
Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat β-hemoglobinopathies that recapitulates a mutation associated with a benign genetic condition. Nat Med. Sep. 2016;22(9):987-90. doi: 10.1038/nm.4170. Epub Aug. 15, 2016.
Trojan et al., Functional analysis of hMLH1 variants and HNPCC-related mutations using a human expression system. Gastroenterology. Jan. 2002;122(1):211-9. doi: 10.1053/gast.2002.30296.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 20135;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
Umar et al., DNA loop repair by human cell extracts. Science. Nov. 4, 1994;266(5186):814-6. doi: 10.1126/science.7973637.
UniProt Consortium, UniProt: the universal protein knowledgebase. Nucleic Acids Res. Mar. 16, 2018;46(5):2699. doi: 10.1093/nar/gky092. Erratum for: Nucleic Acids Res. Jan. 4, 2017;45(D1):D158-D169.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.

(56) References Cited

OTHER PUBLICATIONS

UniProtein A0A1V6. Dec. 11, 2019.
UniProtKB Submission; Accession No. F0NH53. May 3, 2011. 4 pages.
UniProtKB Submission; Accession No. F0NN87. May 3, 2011. 4 pages.
UniProtKB Submission; Accession No. G3ECR1.2. No Author Listed., Aug. 12, 2020, 8 pages.
UniProtKB Submission; Accession No. P04264. No Author Listed., Apr. 7, 2021. 12 pages.
UniProtKB Submission; Accession No. P0DOC6. No Author Listed., Oct. 5, 2016. 5 pages.
UniProtKB Submission; Accession No. T0D7A2. Oct. 16, 2013. 10 pages.
UniProtKB Submission; Accession No. U2UMQ6. No Author Listed., Apr. 7, 2021, 11 pages.
Urasaki et al., Functional dissection of the To12 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Usman et al., Exploiting the chemical synthesis of RNA. Trends Biochem Sci. Sep. 1992;17(9):334-9. doi: 10.1016/0968-0004(92)90306-t.
Vafai et al., Mitochondrial disorders as windows into an ancient organelle. Nature. Nov. 15, 2012;491(7424):374-83. doi: 10.1038/nature11707.
Vagner et al., Efficiency of homologous DNA recombination varies along the Bacillus subtilis chromosome. J Bacteriol. Sep. 1988;170(9):3978-82.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (NY). 1988;6(10):1149-1154. doi: 10.1038/nbt1088-1149.
Van Den Oord et al., Pixel Recurrent Neural Networks. Proceedings of the 33rd International Conference on Machine Learning. Journal of Machine Learning Research. Aug. 19, 2016. vol. 48. 11 pages.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 2020.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vidal et al., Yeast forward and reverse 'n'-hybrid systems. Nucleic Acids Res. Feb. 15, 1999;27(4):919-29. doi: 10.1093/nar/27.4.919.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wallace et al., Mitochondrial DNA genetics and the heteroplasmy conundrum in evolution and disease. Cold Spring Harb Perspect Biol. Nov. 1, 2013;5(11):a021220. doi: 10.1101/cshperspect.a021220.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Walton et al., Unconstrained genome targeting with near-PAMless engineered CRISPR-Cas9 variants. Science. Apr. 17, 2020;368(6488):290-296. doi: 10.1126/science.aba8853. Epub Mar. 26, 2020.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.

(56) References Cited

OTHER PUBLICATIONS

Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science. 1246981. Epub Dec. 12, 2013.
Wang et al., Highly efficient CRISPR/HDR-mediated knock-in for mouse embryonic stem cells and zygotes. Biotechniques. 2015:59,201-2;204;206-8.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Warren et al., Structure of the human MutSalpha DNA lesion recognition complex. Mol Cell. May 25, 2007;26(4):579-92. doi: 10.1016/j.molcel.2007.04.018.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Webb et al., Functional and structural characteristics of NY-ESO-1-related HLA A2-restricted epitopes and the design of a novel immunogenic analogue. J Biol Chem. May 28, 2004;279(22):23438-46. doi: 10.1074/jbc.M314066200. Epub Mar. 5, 2004.
Weber et al., Assembly of designer TAL effectors by Golden Gate cloning. PLoS One. 2011;6(5):e19722. doi:10.1371/journal.pone. 0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human CIC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus δVP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha- helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants. 2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.

(56) References Cited

OTHER PUBLICATIONS

Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 20048;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wirth et al., Mildly affected patients with spinal muscular atrophy are partially protected by an increased SMN2 copy number Hum Genet. May 2006;119(4):422-8. doi: 10.1007/s00439-006-0156-7. Epub Mar. 1, 2006.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Woo et al., Gene activation of SMN by selective disruption of IncRNA-mediated recruitment of PRC2 for the treatment of spinal muscular atrophy. Proc Natl Acad Sci U S A. Feb. 21, 2017;114(8):E1509-E1518. doi: 10.1073/pnas.1616521114. Epub Feb. 13, 2017.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Wu et al., Widespread Influence of 3'-End Structures on Mammalian mRNA Processing and Stability. Cell. May 18, 2017;169(5):905-917.e11. doi: 10.1016/j.cell.2017.04.036.
Xi et al., C-terminal Loop Mutations Determine Folding and Secretion Properties of PCSK9. Biochem Mol Biol J. 2016;2(3):17. doi: 10.21767/2471-8084.100026. 12 pages.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ΦC31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. Embo J. Oct. 1990;9(10):3353-62.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.

(56) References Cited

OTHER PUBLICATIONS

Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.
Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.
Yamano et al., Crystal Structure of Cpf1 in Complex with Guide RNA and Target DNA. Cell. May 5, 2016;165(4):949-62. doi: 10.1016/j.cell.2016.04.003. Epub Apr. 21, 2016.
Yamazaki et al., Segmental Isotope Labeling for Protein NMR Using Peptide Splicing. J. Am. Chem. Soc. May 22, 1998; 120(22):5591-2. https://doi.org/10.1021/ja9807760.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yan et al., Functionally diverse type V CRISPR-Cas systems. Science. Jan. 4, 2019;363(6422):88-91. doi: 10.1126/science.aav7271. Epub Dec. 6, 2018.
Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.
Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.
Yang et al., Mutations in SCN9A, encoding a sodium channel alpha subunit, in patients with primary erythermalgia. J Med Genet. Mar. 2004;41(3):171-4. doi: 10.1136/jmg.2003.012153.
Yang et al., New CRISPR-Cas systems discovered. Cell Res. Mar. 2017;27(3):313-314. doi: 10.1038/cr.2017.21. Epub Feb. 21, 2017.
Yang et al., One Prime for All Editing. Cell. Dec. 12, 2019;179(7):1448-1450. doi: 10.1016/j.cell.2019.11.030.
Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.
Yang et al., PAM-dependent Target DNA Recognition and Cleavage by C2C1 CRISPR-Cas endonuclease. Cell Dec. 2016;167(7):1814-28.
Yang et al., Permanent genetic memory with >1-byte capacity. Nat Methods. Dec. 2014;11(12):1261-6. doi: 10.1038/nmeth.3147. Epub Oct. 26, 2014.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yang et al., Small-molecule control of insulin and PDGF receptor signaling and the role of membrane attachment. Curr Biol. Jan. 1, 1998;8(1):11-8. doi: 10.1016/s0960-9822(98)70015-6.
Yang et al., Targeted elimination of mutant mitochondrial DNA in MELAS-iPSCs by mitoTALENs. Protein Cell. Mar. 2018;9(3):283-297. doi: 10.1007/s13238-017-0499-y. Epub Jan. 9, 2018.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.
Yang, Nucleases: diversity of structure, function and mechanism. Q Rev Biophys. Feb. 2011;44(1):1-93. doi: 10.1017/S0033583510000181. Epub Sep. 21, 2010.
Yang, Paml 4: phylogenetic analysis by maximum likelihood. Mol Biol Evol. Aug. 2007;24(8):1586-91. doi: 10.1093/molbev/msm088. Epub May 4, 2007.
Yang, Phylogenetic Analysis by Maximum Likelihood (PAML). //abacus.gene.ucl.ac.uk/software/paml.html Last accessed Apr. 28, 2021.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Yasui, Alternative excision repair pathways. Cold Spring Harb Perspect Biol. Jun. 1, 2013;5(6):a012617. doi: 10.1101/cshperspect.a012617.
Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.

(56) References Cited

OTHER PUBLICATIONS

Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Youssoufian et al., Mechanisms and consequences of somatic mosaicism in humans. Nat Rev Genet. Oct. 2002;3(10):748-58. doi: 10.1038/nrg906.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Cytosine base editors with minimized unguided DNA and RNA off-target events and high on-target activity. Nat Commun. Apr. 28, 2020;11(1):2052. doi: 10.1038/s41467-020-15887-5.
Yu et al., Dynamic control of Rad51 recombinase by self-association and interaction with BRCA2. Mol Cell. Oct. 2003;12(4):1029-41. doi: 10.1016/s1097-2765(03)00394-0.
Yu et al., Liposome-mediated in vivo E1A gene transfer suppressed dissemination of ovarian cancer cells that overexpress HER-2/neu. Oncogene. Oct. 5, 1995;11(7):1383-8.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.
Zelphati et al., Intracellular delivery of proteins with a new lipid-mediated delivery system. J Biol Chem. Sep. 14, 2001;276(37):35103-10. Epub Jul. 10, 2001.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Large genomic fragment deletions and insertions in mouse using CRISPR/Cas9. PLoS One. Mar. 24, 2015;10(3):e0120396. doi: 10.1371/journal.pone.0120396. 14 pages.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Reconstitution of 5'-directed human mismatch repair in a purified system. Cell. Sep. 9, 2005;122(5):693-705. doi: 10.1016/j.cell.2005.06.027.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhang et al., Ribozymes and Riboswitches: Modulation of RNA Function by Small Molecules. Biochemistry. Nov. 2, 2010;49(43):9123-31. doi: 10.1021/bi1012645.
Zhang et al., Stabilized plasmid-lipid particles for regional gene therapy: formulation and transfection properties. Gene Ther. Aug. 1999;6(8):1438-47.
Zhang et al., II-Clamp-mediated cysteine conjugation. Nat Chem. Feb. 2016;8(2):120-8. doi: 10.1038/nchem.2413. Epub Dec. 21, 2015.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

(56) References Cited

OTHER PUBLICATIONS

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zheng et al., Highly efficient base editing in bacteria using a Cas9-cytidine deaminase fusion. Commun Biol. Apr. 19, 2018;1:32. doi: 10.1038/s42003-018-0035-5.
Zheng et al., Structural basis for the complete resistance of the human prion protein mutant G127V to prion disease. Sci Rep. Sep. 4, 2018;8(1):13211. doi: 10.1038/s41598-018-31394-6.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zhou et al., Cas12a variants designed for lower genome-wide off-target effect through stringent PAM recognition. Mol Ther. Jan. 5, 2022;30(1):244-255. doi: 10.1016/j.ymthe.2021.10.010. Epub Oct. 20, 2021.
Zhou et al., Dynamic m(6)A mRNA methylation directs translational control of heat shock response. Nature. Oct. 22, 2015;526(7574):591-4. doi: 10.1038/nature15377. Epub Oct. 12, 2015.
Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.
Zhou et al., Protective V127 prion variant prevents prion disease by interrupting the formation of dimer and fibril from molecular dynamics simulations. Sci Rep. Feb. 24, 2016;6:21804. doi: 10.1038/srep21804.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.
Zielenski, Genotype and phenotype in cystic fibrosis. Respiration. 2000;67(2):117-33. doi: 10.1159/000029497.
Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.
Zimmerly et al., Group II intron mobility occurs by target DNA-primed reverse transcription. Cell. Aug. 25, 1995;82(4):545-54. doi: 10.1016/0092-8674(95)90027-6.
Zimmermann et al., Molecular interactions and metal binding in the theophylline-binding core of an RNA aptamer. RNA. May 2000;6(5):659-67.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.
Zuker et al., Optimal computer folding of large RNA sequences using thermodynamics and auxiliary information. Nucleic Acids Res. Jan. 10, 1981;9(1):133-48. doi: 10.1093/nar/9.1.133.
Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.
Zuris et al., Cationic lipid-mediated delivery of proteins enables efficient protein-based genome editing in vitro and in vivo. Nat Biotechnol. 2015;33:73-80.
[No Author Listed], Cas14al protein-N terminal adenine deaminase. EBI Acc. No. BKX98589, Seq. ID 265. May 26, 2022. 3 pages.
[No Author Listed], CMP/dCMP-type deaminase domain-containing protein. Uniprot Accession No. A0A2Z6RZE9. Oct. 10, 2018. Accessible at https://www.uniprot.org/uniprotkb/A0A2Z6RZE9/entry. 8 pages.
[No Author Listed], dCas9-5xPlat2AfID-P2A-scFvGCN4sfGFPTET1CD [Cloning vector pPlatTET-gRNA2]. GenBank No. BAV54124. Apr. 18, 2017. 5 pages.
[No Author Listed], NCBI Reference Sequence: WP_032188360.1. Apr. 6, 2015. 1 page.
[No Author Listed], tRNA-specific adenosine deaminase [Candidatus Moranella endobia PCVAL]. GenBank Acc. No. AGJ61179.1. Accessible at https://www.ncbi.nlm.nih.gov/protein/AGJ61179. Jan. 30, 2014. 3 pages.
[No Author Listed], tRNA-specific adenosine deaminase [*Escherichia coli*]. GenBank Acc. No. CTS26096.1. Accessible at https://www.ncbi.nlm.nih.gov/protein/CTS26096.1. Aug. 22, 2015. 1 page.
[No Author Listed], tRNA-specific adenosine deaminase 2 [*Terrapene triunguis*]. GenBank Acc. No. XP_024075810.1. Accessible at https://www.ncbi.nlm.nih.gov/protein/XP_024075810. Jul. 15, 2019. 2 pages.
[No Author Listed], tRNA-specific adenosine deaminase TAD2 isoform X1 [*Oryza sativa* Japonica Group]. GenBank Acc. No. XP_15631651.1. Accessible at https://www.ncbi.nlm.nih.gov/protein/1002254769?sat=58&satkey=133677684. Aug. 7, 2018. 2 pages.
[No Author Listed], tRNA-specific adenosine deaminase TAD2 isoform X2 [*Panicum hallii*]. GenBank Acc. No. XP_025793740.1. Accessible at https://www.ncbi.nlm.nih.gov/protein/025793740. Jul. 27, 2018. 1 page.
[No Author Listed], tRNA-specific adenosine deaminase. Uniprot Accession No. A0A1U7M801. May 10, 2017. Accessible at https://www.uniprot.org/uniprotkb/A0A1U7M801/history. 3 pages.
[No Author Listed], tRNA-specific adenosine deaminase. Uniprot Accession No. A0A1Z4VPW4. Sep. 27, 2017. Accessible at https://www.uniprot.org/uniprotkb/A0A1Z4VPW4/history. 3 pages.
[No Author Listed], tRNA-specific adenosine deaminase. Uniprot Accession No. A0A1Z9LYI9. Oct. 25, 2017. Accessible at https://www.uniprot.org/uniprotkb/A0A1Z9LY19/entry. 12 pages.
[No Author Listed], tRNA-specific adenosine deaminase. Uniprot Accession No. A0A2P5TOZ9. May 23, 2018. Accessible at https://www.uniprot.org/uniprotkb/A0A2P5T0Z9/entry. 10 pages.
[No Author Listed], tRNA-specific adenosine deaminase. Uniprot Accession No. A0A4P6PH16. Jul. 31, 2019. Accessible at https://www.uniprot.org/uniprotkb/A0A4P6PH16/entry. 12 pages.
[No Author Listed], tRNA-specific adenosine deaminase. Uniprot Accession No. A0A520SVM3. Oct. 16, 2019. Accessible at https://www.uniprot.org/uniprotkb/A0A520SVM3/entry. 10 pages.
[No Author Listed], tRNA-specific adenosine deaminase. Uniprot Accession No. U2JUU0. Nov. 13, 2013. Accessible at https://www.uniprot.org/uniprotkb/U2JUU0/entry. 11 pages.
Abed et al., The Gag protein PEG10 binds to RNA and regulates trophoblast stem cell lineage specification. PLoS One. Apr. 5, 2019;14(4):e0214110. doi: 10.1371/journal.pone.0214110.
Abifadel et al., Mutations in PCSK9 cause autosomal dominant hypercholesterolemia. Nat Genet. Jun. 2003;34(2):154-6. doi: 10.1038/ng1161.
Addgene Plasmid #42234. pMJ920. 2013. Retrieved Jan. 22, 2025. 3 pages.

(56) References Cited

OTHER PUBLICATIONS

Adikusuma et al., Versatile single-step-assembly CRISPR/Cas9 vectors for dual gRNA expression. PLoS One. Dec. 6, 2017;12(12):e0187236. doi: 10.1371/journal.pone.0187236.
Alanis-Lobato et al., Frequent loss of heterozygosity in CRISPR-Cas9-edited early human embryos. Proc Natl Acad Sci U S A. Jun. 1, 2021;118(22):e2004832117. doi: 10.1073/pnas.2004832117. Epub Apr. 9, 2021.
Alizadeh et al., HR9: An Important Cell Penetrating Peptide for Delivery of HCV NS3 DNA into HEK-293T Cells. Avicenna J Med Biotechnol. Jan.-Mar. 2020;12(1):44-51.
Alves et al., Base editing as a genetic treatment for spinal muscular atrophy. bioRxiv [Preprint]. Jan. 21, 2023:2023.01.20.524978. 25 pages. doi: 10.1101/2023.01.20.524978.
Alves et al., Base editing as a genetic treatment for spinal muscular atrophy. bioRxiv [Preprint]. Jan. 21, 2023:2023.01.20.524978. doi: 10.1101/2023.01.20.524978.
Alves et al., Immunogenicity of the carcinoembryonic antigen derived peptide 694 in HLA-A2 healthy donors and colorectal carcinoma patients. Cancer Immunol Immunother. Nov. 2007;56(11):1795-805. doi: 10.1007/s00262-007-0323-2. Epub Apr. 20, 2007.
Anderson et al., pegIT—a web-based design tool for prime editing. Nucleic Acids Res. Jul. 2, 2021;49(W1):W505-W509. doi: 10.1093/nar/gkab427.
Anzalone et al., Programmable deletion, replacement, integration and inversion of large DNA sequences with twin prime editing. Nat Biotechnol. May 2022;40(5):731-740. doi: 10.1038/s41587-021-01133-w. Epub Dec. 9, 2021.
Asemissen et al., Identification of a highly immunogenic HLA-A*01-binding T cell epitope of WT1. Clin Cancer Res. Dec. 15, 2006;12(24):7476-82. doi: 10.1158/1078-0432.CCR-06-1337.
Ashley et al., Retrovirus-like Gag Protein Arc1 Binds RNA and Traffics across Synaptic Boutons. Cell. Jan. 11, 2018;172(1-2):262-274.e11. doi: 10.1016/j.cell.2017.12.022.
Attia et al., Autoimmunity correlates with tumor regression in patients with metastatic melanoma treated with anti-cytotoxic T-lymphocyte antigen-4. J Clin Oncol. Sep. 1, 2005;23(25):6043-53. doi: 10.1200/JCO.2005.06.205. Epub Aug. 8, 2005.
Aurisicchio et al., A novel minigene scaffold for therapeutic cancer vaccines. Oncoimmunology. Jan. 1, 2014;3(1):e27529. doi: 10.4161/onci.27529. Epub Jan. 16, 2014.
Avidan et al., Expression and characterization of a recombinant novel reverse transcriptase of a porcine endogenous retrovirus. Virology. Mar. 15, 2003;307(2):341-57. doi: 10.1016/s0042-6822(02)00131-9.
Ayala-Ramirez et al., A new autosomal recessive syndrome consisting of posterior microphthalmos, retinitis pigmentosa, foveoschisis, and optic disc drusen is caused by a MFRP gene mutation. Mol Vis. Dec. 4, 2006;12:1483-9.
Azzam et al., FTO m6A Demethylase in Obesity and Cancer: Implications and Underlying Molecular Mechanisms. Int J Mol Sci. Mar. 30, 2022;23(7):3800. doi: 10.3390/ijms23073800.
Bae et al., Heteroclitic CD33 peptide with enhanced anti-acute myeloid leukemic immunogenicity. Clin Cancer Res. Oct. 15, 2004;10(20):7043-52. doi: 10.1158/1078-0432.CCR-04-0322.
Bae et al., Identification of novel CD33 antigen-specific peptides for the generation of cytotoxic T lymphocytes against acute myeloid leukemia. Cell Immunol. Jan. 2004;227(1):38-50. doi: 10.1016/j.cellimm.2004.01.002.
Bakker et al., Analogues of CTL epitopes with improved MHC class-I binding capacity elicit anti-melanoma CTL recognizing the wild-type epitope. Int J Cancer. Jan. 27, 1997;70(3):302-9. doi: 10.1002/(sici)1097-0215(19970127)70:3<302::aid-ijc10>3.0.co;2-h.
Banerjee et al., Viral glycoproteins: biological role and application in diagnosis. Virusdisease. Mar. 2016;27(1):1-11. doi: 10.1007/s13337-015-0293-5. Epub Jan. 18, 2016.
Baños-Sanz et al., Crystal structure and functional insights into uracil-DNA glycosylase inhibition by phage Φ29 DNA mimic protein p56. Nucleic Acids Res. Jul. 2013;41(13):6761-73. doi: 10.1093/nar/gkt395. Epub May 13, 2013.
Barrera-Paez et al., Mitochondrial genome engineering coming-of-age. Trends Genet. Aug. 2022;38(8):869-880. doi: 10.1016/j.tig.2022.04.011. Epub May 19, 2022. Erratum in: Trends Genet. Aug. 26, 2022.
Barve et al., Induction of immune responses and clinical efficacy in a phase II trial of IDM-2101, a 10-epitope cytotoxic T-lymphocyte vaccine, in metastatic non-small-cell lung cancer. J Clin Oncol. Sep. 20, 2008;26(27):4418-25. doi: 10.1200/JCO.2008.16.6462.
Bender et al., Receptor-Targeted Nipah Virus Glycoproteins Improve Cell-Type Selective Gene Delivery and Reveal a Preference for Membrane-Proximal Cell Attachment. PLoS Pathog. Jun. 9, 2016;12(6):e1005641. doi: 10.1371/journal.ppat.1005641.
Benlalam et al., Identification of five new HLA-B*3501-restricted epitopes derived from common melanoma-associated antigens, spontaneously recognized by tumor-infiltrating lymphocytes. J Immunol. Dec. 1, 2003;171(11):6283-9. doi: 10.4049/jimmunol.171.11.6283.
Bernardi et al., Nucleotide sequence at the binding site for coat protein on RNA of bacteriophage R17. Proc Natl Acad Sci U S A. Oct. 1972;69(10):3033-7. doi: 10.1073/pnas.69.10.3033.
Bernatchez et al., Altered decamer and nonamer from an HLA-A0201-restricted epitope of Survivin differentially stimulate T-cell responses in different individuals. Vaccine. Apr. 5, 2011;29(16):3021-30. doi: 10.1016/j.vaccine.2011.01.115. Epub Feb. 12, 2011.
Bikard et al., Programmable repression and activation of bacterial gene expression using an engineered CRISPR-Cas system. Nucleic Acids Res. Aug. 2013;41(15):7429-37. doi: 10.1093/nar/gkt520. Epub Jun. 12, 2013.
Bioley et al., Melan-A/MART-1-specific CD4 T cells in melanoma patients: identification of new epitopes and ex vivo visualization of specific T cells by MHC class II tetramers. J Immunol. Nov. 15, 2006;177(10):6769-79. doi: 10.4049/jimmunol.177.10.6769.
Blanchet et al., A new generation of Melan-A/MART-1 peptides that fulfill both increased immunogenicity and high resistance to biodegradation: implication for molecular anti-melanoma immunotherapy. J Immunol. Nov. 15, 2001;167(10):5852-61. doi: 10.4049/jimmunol.167.10.5852.
Böck et al., In vivo prime editing of a metabolic liver disease in mice. Sci Transl Med. Mar. 16, 2022;14(636):eabl9238. doi: 10.1126/scitranslmed.abl9238. Epub Mar. 16, 2022. Author Manuscript. 26 pages.
Bolukbasi et al., DNA-binding-domain fusions enhance the targeting range and precision of Cas9. Nat Methods. Dec. 2015;12(12):1150-6. doi: 10.1038/nmeth.3624. Epub Oct. 19, 2015.
Borbulevych et al., Increased immunogenicity of an anchor-modified tumor-associated antigen is due to the enhanced stability of the peptide/MHC complex: implications for vaccine design. J Immunol. Apr. 15, 2005;174(8):4812-20. doi: 10.4049/jimmunol.174.8.4812.
Brichard et al., A tyrosinase nonapeptide presented by HLA-B44 is recognized on a human melanoma by autologous cytolytic T lymphocytes. Eur J Immunol. Jan. 1996;26(1):224-30. doi: 10.1002/eji.1830260135.
Bulcha et al., Viral vector platforms within the gene therapy landscape. Signal Transduct Target Ther. Feb. 8, 2021;6(1):53. doi: 10.1038/s41392-021-00487-6.
Cabeceiras, Novel Extracellular Vesicle Modalities for Delivery of Genome Editor Ribonucleoprotein Complexes. Doctoral dissertation, Harvard University Graduate School of Arts and Sciences. Apr. 29, 2022. Retrieved on Jun. 6, 2024 from: https://nrs.harvard.edu/URN-3:HUL.INSTREPOS:37372269. 138 pages.
Cacabelos et al., Chapter 1—The Epigenetic Machinery in the Life Cycle and Pharmacoepigenetics. Pharmacoepigenetics. vol. 10 in Translational Epigenetics. 2019:1-100. doi: https://doi.org/10.1016/B978-0-12-813939-4.00001-2. 7 pages.
Cai et al. Targeted genome editing by lentiviral protein transduction of zinc-finger and TAL-effector nucleases. Elife. Apr. 24, 2014;3:e01911. doi: 10.7554/eLife.01911.
Cai et al., Abstract OR021: Targeted Genome Editing by Lentiviral Protein Transduction of ZFN and Cas9 Proteins Abstract, Presented at Proceedings of the ESGCT and NVGCT Collaborative Congress: The Hague. Human Gene Therapy. 2014. 15 pages.

(56) References Cited

OTHER PUBLICATIONS

Cai, Protein Transduction Using Lentiviral Vectors for Transposition and Site-directed Gene Editing. Thesis for the degree of Doctor of Philosophy, Aarhus University, Department of Biomedicine. 2014. 74 pages.
Cameron et al., Mapping the genomic landscape of CRISPR-Cas9 cleavage. Nat Methods. Jun. 2017;14(6):600-606 with Erratum. doi: 10.1038/nmeth.4284. Epub May 1, 2017. Erratum in: Nat Methods. Dec. 2023;20(12):2068. doi: 10.1038/s41592-023-02114-4. 8 pages.
Campbell et al., Gesicle-Mediated Delivery of CRISPR/Cas9 Ribonucleoprotein Complex for Inactivating the HIV Provirus. Mol Ther. Jan. 2, 2019;27(1):151-163. doi: 10.1016/j.ymthe.2018.10.002. Epub Oct. 11, 2018.
Campi et al., CD4(+) T cells from healthy subjects and colon cancer patients recognize a carcinoembryonic antigen-specific immunodominant epitope. Cancer Res. Dec. 1, 2003;63(23):8481-6.
Casnici et al., Immunologic evaluation of peptides derived from BCR/ABL-out-of-frame fusion protein in HLA A2.1 transgenic mice. J Immunother. May 2012;35(4):321-8. doi: 10.1097/CJI.0b013e3182562d37.
Casnici et al., Out of frame peptides from BCR/ABL alternative splicing are immunogenic in HLA A2.1 transgenic mice. Cancer Lett. Apr. 8, 2009;276(1):61-7. doi: 10.1016/j.canlet.2008.10.032. Epub Dec. 4, 2008.
Castelli et al., Mass spectrometric identification of a naturally processed melanoma peptide recognized by CD8+ cytotoxic T lymphocytes. J Exp Med. Jan. 1, 1995;181(1):363-8. doi: 10.1084/jem.181.1.363.
Castelli et al., Novel HLA-Cw8-restricted T cell epitopes derived from tyrosinase-related protein-2 and gp100 melanoma antigens. J Immunol. Feb. 1, 1999;162(3):1739-48.
Castle et al., Exploiting the mutanome for tumor vaccination. Cancer Res. Mar. 1, 2012;72(5):1081-91. doi: 10.1158/0008-5472.CAN-11-3722. Epub Jan. 11, 2012.
Cervera et al., Generation of HIV-1 Gag VLPs by transient transfection of HEK 293 suspension cell cultures using an optimized animal-derived component free medium. J Biotechnol. Jul. 20, 2013;166(4):152-65. doi: 10.1016/j.jbiotec.2013.05.001. Epub May 17, 2013.
Chandler et al., Recombinant Adeno-Associated Viral Integration and Genotoxicity: Insights from Animal Models. Hum Gene Ther. Apr. 2017;28(4):314-322. doi: 10.1089/hum.2017.009.
Chang et al., Functional characterization of the placental fusogenic membrane protein syncytin. Biol Reprod. Dec. 2004;71(6):1956-62. doi: 10.1095/biolreprod.104.033340. Epub Jul. 21, 2004.
Chao et al., Measurement of large serine integrase enzymatic characteristics in HEK293 cells reveals variability and influence on downstream reporter expression. FEBS J. Nov. 2021;288(22):6410-6427. doi: 10.1111/febs.16037. Epub Jun. 23, 2021.
Chen et al., DNA methylation and demethylation in mammals. J Biol Chem. May 27, 2011;286(21):18347-53. doi: 10.1074/jbc.R110.205286. Epub Mar. 24, 2011.
Chen et al., Enhancement of a prime editing system via optimal recruitment of the pioneer transcription factor P65. Nat Commun. Jan. 17, 2023;14(1):257. doi: 10.1038/s41467-023-35919-0.
Chen et al., Identification of NY-ESO-1 peptide analogues capable of improved stimulation of tumor-reactive CTL. J Immunol. Jul. 15, 2000;165(2):948-55. doi: 10.4049/jimmunol.165.2.948.
Chen et al., Prime editing for precise and highly versatile genome manipulation. Nat Rev Genet. Mar. 2023;24(3):161-177 and Supplemental Info. doi: 10.1038/s41576-022-00541-1. Epub Nov. 7, 2022. 47 pages.
Chen et al., Programmable C:G to G:C genome editing with CRISPR-Cas9-directed base excision repair proteins. Nat Commun. Mar. 2, 2021;12(1):1384. doi: 10.1038/s41467-021-21559-9.
Cheriyan et al., Faster protein splicing with the Nostoc punctiforme DnaE intein using non-native extein residues. J Biol Chem. Mar. 1, 2013;288(9):6202-11. doi: 10.1074/jbc.M112.433094. Epub Jan. 10, 2013.
Cho et al., Heritable gene knockout in Caenorhabditis elegans by direct injection of Cas9-sgRNA ribonucleoproteins. Genetics. Nov. 2013;195(3):1177-80. doi: 10.1534/genetics.113.155853. Epub Aug. 26, 2013.
Cho et al., Optimized peptide vaccines eliciting extensive CD8 T-cell responses with therapeutic antitumor effects. Cancer Res. Dec. 1, 2009;69(23):9012-9. doi: 10.1158/0008-5472.CAN-09-2019. Epub Nov. 10, 2009.
Choi et al., Lentivirus pre-packed with Cas9 protein for safer gene editing. Gene Ther. Jul. 2016;23(7):627-33. doi: 10.1038/gt.2016.27. Epub Apr. 7, 2016.
Choi et al., Optimization of AAV expression cassettes to improve packaging capacity and transgene expression in neurons. Mol Brain. Mar. 11, 2014;7:17. doi: 10.1186/1756-6606-7-17.
Choi et al., Precise genomic deletions using paired prime editing. Nat Biotechnol. Feb. 2022;40(2):218-226. doi: 10.1038/s41587-021-01025-z. Epub Oct. 14, 2021.
Chow et al., A web tool for the design of prime-editing guide RNAs. Nat Biomed Eng. Feb. 2021;5(2):190-194. doi: 10.1038/s41551-020-00622-8. Epub Sep. 28, 2020.
Christensen et al., Melan-A/MART1 analog peptide triggers anti-myeloma T-cells through crossreactivity with HM1.24. J Immunother. Jul.-Aug. 2009;32(6):613-21. doi: 10.1097/CJI.0b013e3181a95198.
Chylinski et al., The tracrRNA and Cas9 families of type II CRISPR-Cas immunity systems. RNA Biol. May 2013;10(5):Supplementary Material. doi: 10.4161/rna.24321. Epub Apr. 5, 2013. 12 pages.
Cideciyan, Leber congenital amaurosis due to RPE65 mutations and its treatment with gene therapy. Prog Retin Eye Res. Sep. 2010;29(5):398-427. doi: 10.1016/j.preteyeres.2010.04.002. Epub Apr. 24, 2010.
Coey, Sumoylation of thymine DNA glycosylase occurs efficiently and weakens DNA binding but does not regulate enzymatic turnover. Dissertation. 2017. 178 pages.
Cohen et al., Low LDL cholesterol in individuals of African descent resulting from frequent nonsense mutations in PCSK9. Nat Genet. Feb. 2005;37(2):161-5. doi: 10.1038/ng1509. Epub Jan. 16, 2005. Erratum in: Nat Genet. Mar. 2005;37(3):328.
Cohen et al., Sequence variations in PCSK9, low LDL, and protection against coronary heart disease. N Engl J Med. Mar. 23, 2006;354(12):1264-72. doi: 10.1056/NEJMoa054013.
Contreras-Galindo et al., Human Endogenous Retrovirus Type K (HERV-K) Particles Package and Transmit HERV-K-Related Sequences. J Virol. Jul. 2015;89(14):7187-201. doi: 10.1128/JVI.00544-15. Epub Apr. 29, 2015.
Coquin, Characterization of lentiviral vectors pseudotyped with murine syncytins and their cellular targets in vitro and in vivo. Thesis. University of Évry Val d'Essonne. Defense on Dec. 10, 2019. 238 pages.
Correale et al., In vitro generation of human cytotoxic T lymphocytes specific for peptides derived from prostate-specific antigen. J Natl Cancer Inst. Feb. 19, 1997;89(4):293-300. doi: 10.1093/jnci/89.4.293.
Courtney et al., CRISPR/Cas9 DNA cleavage at SNP-derived PAM enables both in vitro and in vivo KRT12 mutation-specific targeting. Gene Ther. Jan. 2016;23(1):108-12. doi: 10.1038/gt.2015.82. Epub Aug. 20, 2015.
Cox et al., Identification of a peptide recognized by five melanoma-specific human cytotoxic T cell lines. Science. Apr. 29, 1994;264(5159):716-9. doi: 10.1126/science.7513441.
Cronin et al., Altering the tropism of lentiviral vectors through pseudotyping. Curr Gene Ther. Aug. 2005;5(4):387-98. doi: 10.2174/1566523054546224. Erratum in: Curr Gene Ther. Oct. 2005;5(5):531. Author Manuscript, 19 pages.
Crosti et al., Identification of novel subdominant epitopes on the carcinoembryonic antigen recognized by CD4+ T cells of lung cancer patients. J Immunol. Apr. 15, 2006;176(8):5093-9. doi: 10.4049/jimmunol.176.8.5093.
Cui et al., KPT330 improves Cas9 precision genome- and base-editing by selectively regulating mRNA nuclear export. Commun Biol. Mar. 17, 2022;5(1):237. doi: 10.1038/s42003-022-03188-0.

(56) References Cited

OTHER PUBLICATIONS

Dalet et al., An antigenic peptide produced by reverse splicing and double asparagine deamidation. Proc Natl Acad Sci U S A. Jul. 19, 2011;108(29):E323-31. doi: 10.1073/pnas.1101892108. Epub Jun. 13, 2011.
Damdindorj et al., A comparative analysis of constitutive promoters located in adeno-associated viral vectors. PLoS One. Aug. 29, 2014;9(8):e106472. doi: 10.1371/journal.pone.0106472.
David et al., Viral Vectors: The Road to Reducing Genotoxicity. Toxicol Sci. Feb. 2017;155(2):315-325. doi: 10.1093/toxsci/kfw220. Epub Nov. 1, 2016.
Davis et al., Efficient in vivo base editing via single adeno-associated viruses with size-optimized genomes encoding compact adenine base editors. Nat Biomed Eng. Nov. 2022;6(11):1272-1283. doi: 10.1038/s41551-022-00911-4. Epub Jul. 28, 2022. Erratum in: Nat Biomed Eng. Aug. 5, 2022.
Debenedictis et al., Measuring the tolerance of the genetic code to altered codon size. Elife. Mar. 16, 2022;11:e76941. doi: 10.7554/eLife.76941.
Debenedictis et al., Multiplex suppression of four quadruplet codons via tRNA directed evolution. Nat Commun. Sep. 29, 2021;12(1):5706. doi: 10.1038/s41467-021-25948-y.
Debenedictis et al., Systematic molecular evolution enables robust biomolecule discovery. Nat Methods. Jan. 2022;19(1):55-64. doi: 10.1038/s41592-021-01348-4. Epub Dec. 30, 2021.
Den Hollander et al., Leber congenital amaurosis: genes, proteins and disease mechanisms. Prog Retin Eye Res. Jul. 2008;27(4):391-419. doi: 10.1016/j.preteyeres.2008.05.003. Epub Jun. 1, 2008.
Depontieu et al., Identification of tumor-associated, MHC class II-restricted phosphopeptides as targets for immunotherapy. Proc Natl Acad Sci U S A. Jul. 21, 2009;106(29):12073-8. doi: 10.1073/pnas.0903852106. Epub Jul. 6, 2009.
Dhindsa et al., A minimal role for synonymous variation in human disease. Am J Hum Genet. Dec. 1, 2022;109(12):2105-2109. doi: 10.1016/j.ajhg.2022.10.016.
Di Stasi et al., Review of the Results of WT1 Peptide Vaccination Strategies for Myelodysplastic Syndromes and Acute Myeloid Leukemia from Nine Different Studies. Front Immunol. Feb. 4, 2015;6:36. doi: 10.3389/fimmu.2015.00036.
Ding et al., Gene therapy for cardiovascular disease. Journal of Shanghai University (Natural Science Edition) . 2016;3:270-9 . DOI: 10.3969/j.issn.1007-2861.2016.03.013.
Doman et al., Designing and executing prime editing experiments in mammalian cells. Nat Protoc. Nov. 2022;17(11):2431-2468. doi: 10.1038/s41596-022-00724-4. Epub Aug. 8, 2022.
Dong et al., Lentiviral Vectors for Delivery of Gene-Editing Systems Based on CRISPR/Cas: Current State and Perspectives. Viruses. Jul. 1, 2021;13(7):1288. doi: 10.3390/v13071288.
Duan et al., Immune rejection of mouse tumors expressing mutated self. Cancer Res. Apr. 15, 2009;69(8):3545-53. doi: 10.1158/0008-5472.CAN-08-2779. Epub Apr. 7, 2009. Author Manuscript. 18 pages.
Duportet et al., A platform for rapid prototyping of synthetic gene networks in mammalian cells. Nucleic Acids Res. Dec. 1, 2014;42(21):13440-51. doi: 10.1093/nar/gku1082. Epub Nov. 5, 2014.
Edraki et al., A Compact, High-Accuracy Cas9 with a Dinucleotide PAM for In Vivo Genome Editing. Mol Cell. Feb. 21, 2019;73(4):714-726.e4 and Supplemental Info. doi: 10.1016/j.molcel.2018.12.003. Epub Dec. 20, 2018.
Ekman et al., CRISPR-Cas9-Mediated Genome Editing Increases Lifespan and Improves Motor Deficits in a Huntington's Disease Mouse Model. Mol Ther Nucleic Acids. Sep. 6, 2019;17:829-839. doi: 10.1016/j.omtn.2019.07.009. Epub Jul. 26, 2019.
Eriksen et al., Occlusion of the Ribosome Binding Site Connects the Translational Initiation Frequency, mRNA Stability and Premature Transcription Termination. Front Microbiol. Mar. 14, 2017;8:362. doi: 10.3389/fmicb.2017.00362.
Farhy-Tselnicker et al., Astrocytes, neurons, synapses: a tripartite view on cortical circuit development. Neural Dev. May 1, 2018;13(1):7. doi: 10.1186/s13064-018-0104-y.
Fehér et al., Characterization of the murine leukemia virus protease and its comparison with the human immunodeficiency virus type 1 protease. J Gen Virol. May 2006;87(Pt 5): 1321-1330. doi: 10.1099/vir.0.81382-0.
Fields et al., Gene targeting techniques for Huntington's disease. Ageing Res Rev. Sep. 2021;70:101385. doi: 10.1016/j.arr.2021.101385. Epub Jun. 5, 2021.
Fikes et al., Design of multi-epitope, analogue-based cancer vaccines. Expert Opin Biol Ther. Sep. 2003;3(6):985-93. doi: 10.1517/14712598.3.6.985.
Fitzgerald et al., Effect of an RNA interference drug on the synthesis of proprotein convertase subtilisin/kexin type 9 (PCSK9) and the concentration of serum LDL cholesterol in healthy volunteers: a randomised, single-blind, placebo-controlled, phase 1 trial. Lancet. Jan. 4, 2014;383(9911):60-68. doi: 10.1016/S0140-6736(13)61914-5. Epub Oct. 3, 2013.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Supplementary Information. 67 pages.
Fontana et al., Rabies virus-like particles expressed in HEK293 cells. Vaccine. May 19, 2014;32(24):2799-804. doi: 10.1016/j.vaccine.2014.02.031. Epub Mar. 12, 2014.
Fonteneau et al., The Tumor Antigen NY-ESO-1 Mediates Direct Recognition of Melanoma Cells by CD4+ T Cells after Intercellular Antigen Transfer. J Immunol. Jan. 1, 2016;196(1):64-71. doi: 10.4049/jimmunol.1402664. Epub Nov. 25, 2015.
Fourcade et al., PD-1 and Tim-3 regulate the expansion of tumor antigen-specific CD8+ T cells induced by melanoma vaccines. Cancer Res. Feb. 15, 2014;74(4):1045-55. doi: 10.1158/0008-5472.CAN-13-2908. Epub Dec. 16, 2013.
Fridman et al., An efficient T-cell epitope discovery strategy using in silico prediction and the iTopia assay platform. Oncoimmunology. Nov. 1, 2012;1(8):1258-1270. doi: 10.4161/onci.21355.
Fujiki et al., Identification and characterization of a WT1 (Wilms Tumor Gene) protein-derived HLA-DRB1*0405-restricted 16-mer helper peptide that promotes the induction and activation of WT1-specific cytotoxic T lymphocytes. J Immunother. Apr. 2007;30(3):282-93. doi: 10.1097/01.cji.0000211337.91513.94.
Gaidukov et al., A multi-landing pad DNA integration platform for mammalian cell engineering. Nucleic Acids Res. May 4, 2018;46(8):4072-4086. doi: 10.1093/nar/gky216.
Gao et al., A truncated reverse transcriptase enhances prime editing by split AAV vectors. Mol Ther. Sep. 7, 2022;30(9):2942-2951 and Supplemental Info. doi: 10.1016/j.ymthe.2022.07.001. Epub Jul. 8, 2022. 23 pages.
Gao et al., Delineation of the Exact Transcription Termination Signal for Type 3 Polymerase III. Mol Ther Nucleic Acids. Mar. 2, 2018;10:36-44. doi: 10.1016/j.omtn.2017.11.006. Epub Nov. 21, 2017.
Gao et al., Genomic and Transcriptomic Analyses of Prime Editing Guide RNA-Independent Off-Target Effects by Prime Editors. CRISPR J. 2022;5(2):276-93. doi: 10.1089/crispr.2021.0080.
Garnier et al., WW domains and retrovirus budding. Nature. Jun. 27, 1996;381(6585):744-5. doi: 10.1038/381744a0.
Gee et al., Extracellular nanovesicles for packaging of CRISPR-Cas9 protein and sgRNA to induce therapeutic exon skipping. Nat Commun. Mar. 13, 2020;11(1):1334. doi: 10.1038/s41467-020-14957-y.
GenBank Access No. BAP64357. Aug. 1, 2013. 1 page.
GenBank Accession No. AAH57574.1 2009. 2 pages.
GenBank Submission; NIH/NCBI, Accession No. NP_060228.2. Bi et al., Dec. 21, 2005. 1 page.
GenBank Submission; NIH/NCBI, Accession No. NP_062826.2. Bokar et al., Sep. 18, 2004. 2 pages.
GenBank Submission; NIH/NCBI, Accession No. NP_066012.1. Ota et al., Apr. 3, 2005. 2 pages.
GenBank Submission; NIH/NCBI, Accession No. WP_042518169.1. No Author, Feb. 10, 2015. 1 page.

(56) References Cited

OTHER PUBLICATIONS

George et al., Efficient and error-free correction of sickle mutation in human erythroid cells using prime editor-2. Front Genome Ed. Dec. 20, 2022;4:1085111. doi: 10.3389/fgeed.2022.1085111.
Geurts et al., Evaluating CRISPR-based prime editing for cancer modeling and CFTR repair in organoids. Life Sci Alliance. Aug. 9, 2021;4(10):e202000940. doi: 10.26508/lsa.202000940.
Geynisman et al., A randomized pilot phase I study of modified carcinoembryonic antigen (CEA) peptide (CAP1-6D)/montanide/GM-CSF-vaccine in patients with pancreatic adenocarcinoma. J Immunother Cancer. Jun. 27, 2013;1:8. doi: 10.1186/2051-1426-1-8.
Ghosh et al., Synapsis in phage Bxb1 integration: selection mechanism for the correct pair of recombination sites. J Mol Biol. Jun. 3, 2005;349(2):331-48. doi: 10.1016/j.jmb.2005.03.043. Epub Apr. 7, 2005.
Giannoukos et al., UDiTaS™, a genome editing detection method for indels and genome rearrangements. BMC Genomics. Mar. 21, 2018;19(1):212. doi: 10.1186/s12864-018-4561-9.
Girard-Gagnepain et al., Baboon envelope pseudotyped LVs outperform VSV-G-LVs for gene transfer into early-cytokine-stimulated and resting HSCs. Blood. Aug. 21, 2014;124(8):1221-31. doi: 10.1182/blood-2014-02-558163. Epub Jun. 20, 2014.
Godefroy et al., Identification of two Melan-A CD4+ T cell epitopes presented by frequently expressed MHC class II alleles. Clin Immunol. Oct. 2006; 121(1):54-62. doi: 10.1016/j.clim.2006.05.007. Epub Jun. 30, 2006.
Golczak et al., Importance of membrane structural integrity for RPE65 retinoid isomerization activity. J Biol Chem. Mar. 26, 2010;285(13):9667-9682. doi: 10.1074/jbc.M109.063941. Epub Jan. 25, 2010.
Graff-Dubois et al., Generation of CTL recognizing an HLA-A*0201-restricted epitope shared by MAGE-A1, -A2, -A3, -A4, -A6, -A10, and -A12 tumor antigens: implication in a broad-spectrum tumor immunotherapy. J Immunol. Jul. 1, 2002;169(1):575-80. doi: 10.4049/jimmunol.169.1.575.
Gross et al., High vaccination efficiency of low-affinity epitopes in antitumor immunotherapy. J Clin Invest. Feb. 2004;113(3):425-33. doi: 10.1172/JCI19418.
Guevara-Patiño et al., Optimization of a self antigen for presentation of multiple epitopes in cancer immunity. J Clin Invest. May 2006;116(5):1382-90. doi: 10.1172/JCI25591. Epub Apr. 13, 2006.
Guibinga et al., Cell surface heparan sulfate is a receptor for attachment of envelope protein-free retrovirus-like particles and VSV-G pseudotyped MLV-derived retrovirus vectors to target cells. Mol Ther. May 2002;5(5 Pt 1):538-46. doi: 10.1006/mthe.2002.0578.
Gulley et al., Combining a Recombinant Cancer Vaccine with Standard Definitive Radiotherapy in Patients with Localized Prostate Cancer. Clin Cancer Res. May 2, 2005;11(9):3353-62. doi: 10.1158/1078-0432.CCR-04-2062.
Guo et al., Direct recognition and lysis of leukemia cells by WT1-specific CD4+ T lymphocytes in an HLA class II-restricted manner. Blood. Aug. 15, 2005;106(4):1415-8. doi: 10.1182/blood-2005-01-0413. Epub Apr. 21, 2005.
Guo et al., Precision modeling of mitochondrial diseases in zebrafish via DdCBE-mediated mtDNA base editing. Cell Discov. Sep. 3, 2021;7(1):78. doi: 10.1038/s41421-021-00307-9.
Gusel'Nikova et al., NeuN as a Neuronal Nuclear Antigen and Neuron Differentiation Marker. Acta Naturae. Apr.-Jun. 2015;7(2):42-7.
Gutkin et al., RNA delivery with a human virus-like particle. Nat Biotechnol. Dec. 2021;39(12):1514-1515. doi: 10.1038/s41587-021-01124-x.
Habib et al., Comprehensive analysis of prime editing outcomes in human embryonic stem cells. Nucleic Acids Res. Jan. 25, 2022;50(2):1187-1197. doi: 10.1093/nar/gkab1295.
Haeussler et al., Genome Editing with CRISPR-Cas9: Can It Get Any Better? J Genet Genomics. May 20, 2016;43(5):239-50. doi: 10.1016/j.jgg.2016.04.008. Epub Apr. 24, 2016. Author Manuscript. 22 pages.
Hamilton et al., Cell type-programmable genome editing with enveloped delivery vehicles. bioRxiv preprint. Aug. 24, 2022. doi: 10.1101/2022.08.25.505004. 22 pages.
Hamilton et al., Knocking out barriers to engineered cell activity. Science. Feb. 28, 2020;367(6481):976-977. doi: 10.1126/science.aba9844. Epub Feb. 6, 2020.
Hamilton et al., Targeted delivery of CRISPR-Cas9 and transgenes enables complex immune cell engineering. Cell Rep. Jun. 1, 2021;35(9):109207. doi: 10.1016/j.celrep.2021.109207.
Heins et al., Designing Automated, High-throughput, Continuous Cell Growth Experiments Using eVOLVER. J Vis Exp. May 19, 2019;(147):10.3791/59652. doi: 10.3791/59652.
Heintze et al., A CRISPR CASe for high-throughput silencing. Front Genet. Oct. 7, 2013;4:193. doi: 10.3389/fgene.2013.00193.
Herbst-Kralovetz et al., Norwalk virus-like particles as vaccines. Expert Rev Vaccines. Mar. 2010;9(3):299-307. doi: 10.1586/erv.09.163. Author Manuscript, 16 pages.
Hirohashi et al., An HLA-A24-restricted cytotoxic T lymphocyte epitope of a tumor-associated protein, survivin. Clin Cancer Res. Jun. 2002;8(6):1731-9.
Hizi et al., Retroviral reverse transcriptases (other than those of HIV-1 and murine leukemia virus): a comparison of their molecular and biochemical properties. Virus Res. Jun. 2008; 134(1-2):203-20. doi: 10.1016/j.virusres.2007.12.008. Epub Mar. 3, 2008.
Hong et al., Novel recombinant hepatitis B virus vectors efficiently deliver protein and RNA encoding genes into primary hepatocytes. J Virol. Jun. 2013;87(12):6615-24. doi: 10.1128/JVI.03328-12. Epub Apr. 3, 2013.
Hooper et al., The C679X mutation in PCSK9 is present and lowers blood cholesterol in a Southern African population. Atherosclerosis. Aug. 2007;193(2):445-8. doi: 10.1016/j.atherosclerosis.2006.08.039. Epub Sep. 20, 2006.
Houghton et al., Immunological validation of the EpitOptimizer program for streamlined design of heteroclitic epitopes. Vaccine. Jul. 20, 2007;25(29):5330-42. doi: 10.1016/j.vaccine.2007.05.008. Epub Jun. 4, 2007.
Hu et al., Discovery and engineering of small SlugCas9 with broad targeting range and high specificity and activity. Nucleic Acids Res. Apr. 19, 2021;49(7):4008-4019. doi: 10.1093/nar/gkab148.
Huang et al., High-throughput continuous evolution of compact Cas9 variants targeting single-nucleotide-pyrimidine PAMs. Nat Biotechnol. Jan. 2023;41(1):96-107. doi: 10.1038/s41587-022-01410-2. Epub Sep. 8, 2022.
Hwang et al., Heritable and precise zebrafish genome editing using a CRISPR-Cas system. PLoS One. Jul. 9, 2013;8(7):e68708. doi: 10.1371/journal.pone.0068708.
Hwang et al., PE-Designer and PE-Analyzer: web-based design and analysis tools for CRISPR prime editing. Nucleic Acids Res. Jul. 2, 2021;49(W1):W499-W504. doi: 10.1093/nar/gkab319.
Ikwuagwu et al., Virus-like particles for drug delivery: a review of methods and applications. Curr Opin Biotechnol. Dec. 2022;78:102785. doi: 10.1016/j.copbio.2022.102785. Epub Sep. 10, 2022.
Indikova et al., Highly efficient 'hit-and-run' genome editing with unconcentrated lentivectors carrying Vpr.Prot.Cas9 protein produced from RRE-containing transcripts. Nucleic Acids Res. Aug. 20, 2020;48(14):8178-8187. doi: 10.1093/nar/gkaa561.
Jacobs et al., DNA glycosylases: in DNA repair and beyond. Chromosoma. Feb. 2012;121(1):1-20. doi: 10.1007/s00412-011-0347-4. Epub Nov. 3, 2011. 20 pages.
Jalaguier et al., Efficient production of HIV-1 virus-like particles from a mammalian expression vector requires the N-terminal capsid domain. PLoS One. 2011;6(11):e28314. doi: 10.1371/journal.pone.0028314. Epub Nov. 30, 2011.
Jang et al., Application of prime editing to the correction of mutations and phenotypes in adult mice with liver and eye diseases. Nat Biomed Eng. Feb. 2022;6(2):181-194. doi: 10.1038/s41551-021-00788-9. Epub Aug. 26, 2021.

(56) References Cited

OTHER PUBLICATIONS

Jang et al., High-purity production and precise editing of DNA base editing ribonucleoproteins. Sci Adv. Aug. 27, 2021;7(35):eabg2661. doi: 10.1126/sciadv.abg2661.
Jaramillo et al., Identification of HLA-A3-restricted CD8+ T cell epitopes derived from mammaglobin-A, a tumor-associated antigen of human breast cancer. Int J Cancer. Dec. 10, 2002;102(5):499-506. doi: 10.1002/ijc.10736.
Jeong et al., Current Status and Challenges of DNA Base Editing Tools. Mol Ther. Sep. 2, 2020;28(9):1938-1952. doi: 10.1016/j.ymthe.2020.07.021. Epub Jul. 23, 2020.
Jiang et al., Deletion and replacement of long genomic sequences using prime editing. Nat Biotechnol. Feb. 2022;40(2):227-234. doi: 10.1038/s41587-021-01026-y. Epub Oct. 14, 2021.
Jiao et al., Random-PE: an efficient integration of random sequences into mammalian genome by prime editing. Mol Biomed. Nov. 18, 2021;2(1):36. doi: 10.1186/s43556-021-00057-w.
Jin et al., Genome-wide specificity of prime editors in plants. Nat Biotechnol. Oct. 2021;39(10):1292-1299. doi: 10.1038/s41587-021-00891-x. Epub Apr. 15, 2021.
Jinek et al., A programmable dual-RNA-guided DNA endonuclease in adaptive bacterial immunity. Science. Aug. 17, 2012;337(6096):Supplementary Material. doi: 10.1126/science.1225829. Epub Jun. 28, 2012. 37 pages.
Jo et al., Therapeutic adenine base editing corrects nonsense mutation and improves visual function in a mouse model of Leber congenital amaurosis. bioRxiv preprint. Jan. 8, 2021. doi: 10.1101/2021.01.07.425822. 19 pages.
Joglekar et al., Pseudotyped Lentiviral Vectors: One Vector, Many Guises. Hum Gene Ther Methods. Dec. 2017;28(6):291-301. doi: 10.1089/hgtb.2017.084. Epub Sep. 4, 2017.
Johnson et al., Mass spectrometry analysis reveals differences in the host cell protein species found in pseudotyped lentiviral vectors. Biologicals. Mar. 2018;52:59-66. doi: 10.1016/j.biologicals.2017.12.005. Epub Feb. 1, 2018.
Johnson et al., Therapeutic landscape for Batten disease: current treatments and future prospects. Nat Rev Neurol. Mar. 2019;15(3):161-178. doi: 10.1038/s41582-019-0138-8.
Johnson, Origins and evolutionary consequences of ancient endogenous retroviruses. Nat Rev Microbiol. Jun. 2019;17(6):355-370. doi: 10.1038/s41579-019-0189-2.
Kaczmarczyk et al., Protein delivery using engineered virus-like particles. Proc Natl Acad Sci U S A. Oct. 11, 2011;108(41):16998-7003. doi: 10.1073/pnas.1101874108. Epub Sep. 26, 2011.
Kameya et al., Mfrp, a gene encoding a frizzled related protein, is mutated in the mouse retinal degeneration 6. Hum Mol Genet. Aug. 1, 2002;11(16):1879-86. doi: 10.1093/hmg/11.16.1879.
Kang et al., Chimeric rabies virus-like particles containing membrane-anchored GM-CSF enhances the immune response against rabies virus. Viruses. Mar. 11, 2015;7(3):1134-52. doi: 10.3390/v7031134.
Kang et al., Chloroplast and mitochondrial DNA editing in plants. Nat Plants. Jul. 2021;7(7):899-905. doi: 10.1038/s41477-021-00943-9. Epub Jul. 1, 2021.
Kang et al., Identification of a tyrosinase epitope recognized by HLA-A24-restricted, tumor-infiltrating lymphocytes. J Immunol. Aug. 1, 1995;155(3):1343-8.
Kantor et al., CRISPR-Cas9 DNA Base-Editing and Prime-Editing. Int J Mol Sci. Aug. 28, 2020;21(17):6240. doi: 10.3390/ijms21176240.
Karbach et al., Long-term complete remission following radiosurgery and immunotherapy in a melanoma patient with brain metastasis: immunologic correlates. Cancer Immunol Res. May 2014;2(5):404-9. doi: 10.1158/2326-6066.CIR-13-0200. Epub Feb. 5, 2014.
Karimian et al., CRISPR/Cas9 novel therapeutic road for the treatment of neurodegenerative diseases. Life Sci. Oct. 15, 2020;259:118165. doi: 10.1016/j.lfs.2020.118165. Epub Jul. 29, 2020.
Karvelis et al., PAM recognition by miniature CRISPR-Cas12f nucleases triggers programmable double-stranded DNA target cleavage. Nucleic Acids Res. May 21, 2020;48(9):5016-5023. doi: 10.1093/nar/gkaa208.
Kato et al., A lentiviral strategy for highly efficient retrograde gene transfer by pseudotyping with fusion envelope glycoprotein. Hum Gene Ther. Feb. 2011;22(2):197-206. doi: 10.1089/hum.2009.179. Epub Jan. 27, 2011.
Kato et al., Selective neural pathway targeting reveals key roles of thalamostriatal projection in the control of visual discrimination. J Neurosci. Nov. 23, 2011;31(47):17169-79. doi: 10.1523/JNEUROSCI.4005-11.2011.
Katoh et al., Exploitation of the interaction of measles virus fusogenic envelope proteins with the surface receptor CD46 on human cells for microcell-mediated chromosome transfer. BMC Biotechnol. May 6, 2010;10:37. doi: 10.1186/1472-6750-10-37.
Kawakami et al., Identification of a human melanoma antigen recognized by tumor-infiltrating lymphocytes associated with in vivo tumor rejection. Proc Natl Acad Sci U S A. Jul. 5, 1994;91(14):6458-62. doi: 10.1073/pnas.91.14.6458.
Kawakami et al., Identification of new melanoma epitopes on melanosomal proteins recognized by tumor infiltrating T lymphocytes restricted by HLA-A1, -A2, and -A3 alleles. J Immunol. Dec. 15, 1998;161(12):6985-92.
Kawakami et al., Identification of the immunodominant peptides of the MART-1 human melanoma antigen recognized by the majority of HLA-A2-restricted tumor infiltrating lymphocytes. J Exp Med. Jul. 1, 1994;180(1):347-52. doi: 10.1084/jem.180.1.347.
Kawakami et al., Recognition of multiple epitopes in the human melanoma antigen gp100 by tumor-infiltrating T lymphocytes associated with in vivo tumor regression. J Immunol. Apr. 15, 1995;154(8):3961-8.
Kawashima et al., Identification of gp100-derived, melanoma-specific cytotoxic T-lymphocyte epitopes restricted by HLA-A3 supertype molecules by primary in vitro immunization with peptide-pulsed dendritic cells. Int J Cancer. Nov. 9, 1998;78(4):518-24. doi: 10.1002/(sici)1097-0215(19981109)78:4<518::aid-ijc20>3.0.co;2-0.
Kawashima et al., Identification of HLA-A3-restricted cytotoxic T lymphocyte epitopes from carcinoembryonic antigen and HER-2/neu by primary in vitro immunization with peptide-pulsed dendritic cells. Cancer Res. Jan. 15, 1999;59(2):431-5.
Kawashima et al., The multi-epitope approach for immunotherapy for cancer: identification of several CTL epitopes from various tumor-associated antigens expressed on solid epithelial tumors. Hum Immunol. Jan. 1998;59(1):1-14. doi: 10.1016/s0198-8859(97)00255-3.
Kazemian et al., Lipid-Nanoparticle-Based Delivery of CRISPR/Cas9 Genome-Editing Components. Mol Pharm. Jun. 6, 2022;19(6):1669-1686. doi: 10.1021/acs.molpharmaceut.1c00916. Epub May 20, 2022.
Kemmler et al., Elevated tumor-associated antigen expression suppresses variant peptide vaccine responses. J Immunol. Nov. 1, 2011;187(9):4431-9. doi: 10.4049/jimmunol.1101555. Epub Sep. 21, 2011.
Kim et al., AAV-deliverable hypercompact adenine base editors based on transposase B guided by engineered RNA. Research Square. Apr. 12, 2022. DOI: 10.21203/r9.3.rs-1326630/v1. Retrieved from https://www.researchsquare.com/articleIrs-1326630/v1 on Aug. 1, 2023. 20 pages.
Kim et al., Unbiased investigation of specificities of prime editing systems in human cells. Nucleic Acids Res. Oct. 9, 2020;48(18):10576-10589. doi: 10.1093/nar/gkaa764.
Kirshenboim et al., Expression and characterization of a novel reverse transcriptase of the LTR retrotransposon Tf1. Virology. Sep. 30, 2007;366(2):263-76. doi: 10.1016/j.virol.2007.04.002. Epub May 23, 2007.
Kittlesen et al., Human melanoma patients recognize an HLA-A1-restricted CTL epitope from tyrosinase containing two cysteine residues: implications for tumor vaccine development. J Immunol. Mar. 1, 1998;160(5):2099-106. Erratum in: J Immunol Mar. 1, 1999;162(5):3106. Shabanowitz JA [corrected to Shabanowitz J].

(56) References Cited

OTHER PUBLICATIONS

Kizer et al., Application of functional genomics to pathway optimization for increased isoprenoid production. Appl Environ Microbiol. May 2008;74(10):3229-41. doi: 10.1128/AEM.02750-07. Epub Mar. 14, 2008.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015. Author Manuscript, 14 pages.
Kneissl et al., Measles virus glycoprotein-based lentiviral targeting vectors that avoid neutralizing antibodies. PLoS One. 2012;7(10):e46667. doi: 10.1371/journal.pone.0046667. Epub Oct. 10, 2012.
Knipping et al., Disruption of HIV-1 co-receptors CCR5 and CXCR4 in primary human T cells and hematopoietic stem and progenitor cells using base editing. Mol Ther. Jan. 5, 2022;30(1):130-144. doi: 10.1016/j.ymthe.2021.10.026. Epub Nov. 2, 2021.
Kobayashi et al., CD4+ T cells from peripheral blood of a melanoma patient recognize peptides derived from nonmutated tyrosinase. Cancer Res. Jan. 15, 1998;58(2):296-301.
Kobayashi et al., Identification of an antigenic epitope for helper T lymphocytes from carcinoembryonic antigen. Clin Cancer Res. Oct. 2002;8(10):3219-25.
Kobayashi et al., Identification of helper T-cell epitopes that encompass or lie proximal to cytotoxic T-cell epitopes in the gp100 melanoma tumor antigen. Cancer Res. Oct. 15, 2001;61(20):7577-84.
Kotterman et al., Engineering adeno-associated viruses for clinical gene therapy. Nat Rev Genet. Jul. 2014;15(7):445-51. doi: 10.1038/nrg3742. Epub May 20, 2014.
Kuang et al., Advances in base editing with an emphasis on an AAV-based strategy. Methods. Oct. 2021;194:56-64. doi: 10.1016/j.ymeth.2021.03.015. Epub Mar. 25, 2021.
Kueh et al., The new editor-targeted genome engineering in the absence of homology-directed repair. Cell Death Discov. Jun. 13, 2016;2:16042. doi: 10.1038/cddiscovery.2016.42.
Kulcsár et al., Blackjack mutations improve the on-target activities of increased fidelity variants of SpCas9 with 5'G-extended sgRNAs. Nat Commun. Mar. 6, 2020;11(1):1223. doi: 10.1038/s41467-020-15021-5.
Kurt et al., CRISPR C-to-G base editors for inducing targeted DNA transversions in human cells. Nat Biotechnol. Jan. 2021;39(1):41-46. doi: 10.1038/s41587-020-0609-x. Epub Jul. 20, 2020.
Kushnir et al., Virus-like particles as a highly efficient vaccine platform: diversity of targets and production systems and advances in clinical development. Vaccine. Dec. 17, 2012;31(1):58-83. doi: 10.1016/j.vaccine.2012.10.083. Epub Nov. 6, 2012.
Kwon et al., Precision targeting tumor cells using cancer-specific InDel mutations with CRISPR-Cas9. Proc Natl Acad Sci U S A. Mar. 1, 2022;119(9):e2103532119. doi: 10.1073/pnas.2103532119.
Lally et al., Unmasking cryptic epitopes after loss of immunodominant tumor antigen expression through epitope spreading. Int J Cancer. Sep. 2001;93(6):841-7. doi: 10.1002/ijc.1420.
Lapointe et al., Retrovirally transduced human dendritic cells can generate T cells recognizing multiple MHC class I and class II epitopes from the melanoma antigen glycoprotein 100. J Immunol. Oct. 15, 2001;167(8):4758-64. doi: 10.4049/jimmunol.167.8.4758.
Larrieu et al., A HLA-Cw*0701 restricted Melan-A/MART1 epitope presented by melanoma tumor cells to CD8+ tumor infiltrating lymphocytes. Cancer Immunol Immunother. May 2008;57(5):745-52. doi: 10.1007/s00262-007-0436-7. Epub Dec. 21, 2007.
Latham et al., Formation of wild-type and chimeric influenza virus-like particles following simultaneous expression of only four structural proteins. J Virol. Jul. 2001;75(13):6154-65. doi: 10.1128/JVI.75.13.6154-6165.2001.
Lau et al., In vivo epigenome editing and transcriptional modulation using CRISPR technology. Transgenic Res. Dec. 2018;27(6):489-509. doi: 10.1007/s11248-018-0096-8. Epub Oct. 4, 2018.
Lazzarotto et al., CHANGE-seq reveals genetic and epigenetic effects on CRISPR-Cas9 genome-wide activity. Nat Biotechnol. Nov. 2020;38(11):1317-1327. doi: 10.1038/s41587-020-0555-7. Epub Jun. 15, 2020.
Lebar et al., A tunable orthogonal coiled-coil interaction toolbox for engineering mammalian cells. Nat Chem Biol. May 2020;16(5):513-519. doi: 10.1038/s41589-019-0443-y. Epub Jan. 6, 2020.
Lee et al., Mitochondrial DNA editing in mice with DddA-TALE fusion deaminases. Nat Commun. Feb. 19, 2021;12(1):1190. doi: 10.1038/s41467-021-21464-1.
Lee et al., Reconstitution of an infectious human endogenous retrovirus. PLoS Pathog. Jan. 2007;3(1):e10. doi: 10.1371/journal.ppat.0030010.
Leenay et al., Identifying and Visualizing Functional PAM Diversity across CRISPR-Cas Systems. Mol Cell. Apr. 7, 2016;62(1):137-47. doi: 10.1016/j.molcel.2016.02.031. Epub Mar. 31, 2016.
Leibowitz et al., Chromothripsis as an on-target consequence of CRISPR-Cas9 genome editing. Nat Genet. Jun. 2021;53(6):895-905. doi: 10.1038/s41588-021-00838-7. Epub Apr. 12, 2021.
Leibundgut-Landmann et al., Mini-review: Specificity and expression of CIITA, the master regulator of MHC class II genes. Eur J Immunol. Jun. 2004;34(6):1513-25. doi: 10.1002/eji.200424964.
Lennerz et al., The response of autologous T cells to a human melanoma is dominated by mutated neoantigens. Proc Natl Acad Sci U S A. Nov. 1, 2005;102(44):16013-8. doi: 10.1073/pnas.0500090102. Epub Oct. 24, 2005.
Leonard et al., CDKL5 deficiency disorder: clinical features, diagnosis, and management. Lancet Neurol. Jun. 2022;21(6):563-576. doi: 10.1016/S1474-4422(22)00035-7. Epub Apr. 25, 2022.
Li et al., A dominant-negative form of mouse SOX2 induces trophectoderm differentiation and progressive polyploidy in mouse embryonic stem cells. J Biol Chem. Jul. 6, 2007;282(27):19481-92. doi: 10.1074/jbc.M702056200. Epub May 15, 2007.
Li et al., Base-Resolution Mapping Reveals Distinct m1A Methylome in Nuclear- and Mitochondrial-Encoded Transcripts. Mol Cell. Dec. 7, 2017;68(5):993-1005.e9. doi: 10.1016/j.molcel.2017.10.019. Epub Nov. 5, 2017.
Li et al., Expression and self-assembly of empty virus-like particles of hepatitis E virus. J Virol. Oct. 1997;71(10):7207-13. doi: 10.1128/JVI.71.10.7207-7213.1997.
Li et al., The Importance of Glycans of Viral and Host Proteins in Enveloped Virus Infection. Front Immunol. Apr. 29, 2021;12:638573. doi: 10.3389/fimmu.2021.638573.
Lim et al., Nuclear and mitochondrial DNA editing in human cells with zinc finger deaminases. Nat Commun. Jan. 18, 2022;13(1):366. doi: 10.1038/s41467-022-27962-0.
Lim et al., Specific insertions of zinc finger domains into Gag-Pol yield engineered retroviral vectors with selective integration properties. Proc Natl Acad Sci U S A. Jul. 13, 2010;107(28):12475-80. doi: 10.1073/pnas.1001402107. Epub Jun. 28, 2010.
Lin et al., CRISPR base editor treats premature-aging syndrome. Signal Transduct Target Ther. Apr. 16, 2021;6(1):158. doi: 10.1038/s41392-021-00576-6.
Lin et al., HLA-DPB1*05: 01-restricted WT1332-specific TCR-transduced CD4+ T lymphocytes display a helper activity for WT1-specific CTL induction and a cytotoxicity against leukemia cells. J Immunother. Apr. 2013;36(3):159-70. doi: 10.1097/CJI.0b013e3182873581.
Lin et al., Modeling a cataract disorder in mice with prime editing. Mol Ther Nucleic Acids. Jul. 2, 2021;25:494-501. doi: 10.1016/j.omtn.2021.06.020.
Liu et al., A split prime editor with untethered reverse transcriptase and circular RNA template. Nat Biotechnol. Sep. 2022;40(9):1388-1393. doi: 10.1038/s41587-022-01255-9. Epub Apr. 4, 2022.
Liu et al., Delivery methods for site-specific nucleases: Achieving the full potential of therapeutic gene editing. J Control Release. Dec. 28, 2016;244(Pt A):83-97. doi: 10.1016/j.jconrel.2016.11.014. Epub Nov. 16, 2016.
Liu et al., Efficient and high-fidelity base editor with expanded PAM compatibility for cytidine dinucleotide. Sci China Life Sci. Aug. 2021;64(8):1355-1367. doi: 10.1007/s11427-020-1775-2. Epub Jan. 6, 2021.

(56) References Cited

OTHER PUBLICATIONS

Liu et al., Efficient generation of mouse models with the prime editing system. Cell Discov. Apr. 28, 2020;6:27. doi: 10.1038/s41421-020-0165-z.
Liu et al., Improved prime editors enable pathogenic allele correction and cancer modelling in adult mice. Nat Commun. Apr. 9, 2021;12(1):2121. doi: 10.1038/s41467-021-22295-w.
Loughrey et al., Non-liver mRNA Delivery. Acc Chem Res. Jan. 4, 2022;55(1):13-23. doi: 10.1021/acs.accounts.1c00601. Epub Dec. 3, 2021.
Lu et al., Lentiviral Capsid-Mediated *Streptococcus pyogenes* Cas9 Ribonucleoprotein Delivery for Efficient and Safe Multiplex Genome Editing. CRISPR J. Dec. 2021;4(6):914-928. doi: 10.1089/crispr.2020.0106. Epub Mar. 16, 2021.
Lu, Periodic Chart of Amino Acid PDF. Accessed on the internet at https://figshare.com/articles/figure/periodic_chart_of_amino_acid_pdf/3445001/1. Posted Jun. 21, 2016. www.bachem.com. 1 page.
Ludwig et al., Virus-like particles-universal molecular toolboxes. Curr Opin Biotechnol. Dec. 2007;18(6):537-45. doi: 10.1016/j.copbio.2007.10.013.
Lueck et al., Engineered transfer RNAs for suppression of premature termination codons. Nat Commun. Feb. 18, 2019;10(1):822. doi: 10.1038/s41467-019-08329-4.
Lupetti et al., Translation of a retained intron in tyrosinase-related protein (TRP) 2 mRNA generates a new cytotoxic T lymphocyte (CTL)-defined and shared human melanoma antigen not expressed in normal cells of the melanocytic lineage. J Exp Med. Sep. 21, 1998;188(6):1005-16. doi: 10.1084/jem.188.6.1005.
Lyu et al., Adenine Base Editor Ribonucleoproteins Delivered by Lentivirus-Like Particles Show High On-Target Base Editing and Undetectable RNA Off-Target Activities. CRISPR J. Feb. 2021;4(1):69-81. doi: 10.1089/crispr.2020.0095.
Lyu et al., Delivering Cas9/sgRNA ribonucleoprotein (RNP) by lentiviral capsid-based bionanoparticles for efficient 'hit-and-run' genome editing. Nucleic Acids Res. Sep. 26, 2019;47(17):e99. doi: 10.1093/nar/gkz605.
Ma et al., Generation of pathogenic TPP1 mutations in human stem cells as a model for neuronal ceroid lipofuscinosis type 2 disease. Stem Cell Res. May 2021;53:102323. doi: 10.1016/j.scr.2021.102323. Epub Apr. 6, 2021.
Ma et al., Pol III Promoters to Express Small RNAs: Delineation of Transcription Initiation. Mol Ther Nucleic Acids. May 6, 2014;3(5):e161. doi: 10.1038/mtna.2014.12.
Maetzig et al., Retroviral protein transfer: falling apart to make an impact. Curr Gene Ther. Oct. 2012;12(5):389-409. doi: 10.2174/156652312802762581.
Mandic et al., The alternative open reading frame of LAGE-1 gives rise to multiple promiscuous HLA-DR-restricted epitopes recognized by T-helper 1-type tumor-reactive CD4+ T cells. Cancer Res. Oct. 1, 2003;63(19):6506-15.
Mangeot et al., A universal transgene silencing method based on RNA interference. Nucleic Acids Res. Jul. 12, 2004;32(12):e102. doi: 10.1093/nar/gnh105.
Mangeot et al., Development of minimal lentivirus vectors derived from simian immunodeficiency virus (SIVmac251) and their use for gene transfer into human dendritic cells. J Virol. Sep. 2000;74(18):8307-15. doi: 10.1128/jvi.74.18.8307-8315.2000.
Mangeot et al., Protein transfer into human cells by VSV-G-induced nanovesicles. Mol Ther. Sep. 2011;19(9):1656-66. doi: 10.1038/mt.2011.138. Epub Jul. 12, 2011.
Mariani et al., Species-specific exclusion of APOBEC3G from HIV-1 virions by Vif. Cell. Jul. 11, 2003;114(1):21-31. doi: 10.1016/s0092-8674(03)00515-4.
Martín et al., Envelope-targeted retrovirus vectors transduce melanoma xenografts but not spleen or liver. Mol Ther. Mar. 2002;5(3):269-74. doi: 10.1006/mthe.2002.0550.
Mason et al., Coiled coil domains: stability, specificity, and biological implications. Chembiochem. Feb. 6, 2004;5(2):170-6. doi: 10.1002/cbic.200300781.
Mathis et al., Predicting prime editing efficiency and product purity by deep learning. Nat Biotechnol. Aug. 2023;41(8):1151-1159. doi: 10.1038/s41587-022-01613-7. Epub Jan. 16, 2023.
Meng et al., Identification of an HLA-DPB1*0501 restricted Melan-A/MART-1 epitope recognized by CD4+ T lymphocytes: prevalence for immunotherapy in Asian populations. J Immunother. Sep. 2011;34(7):525-34. doi: 10.1097/CJI.0b013e318226bd45. Author Manuscript. 16 pages.
Mercuri et al., Nusinersen versus Sham Control in Later-Onset Spinal Muscular Atrophy. N Engl J Med. Feb. 15, 2018;378(7):625-635. doi: 10.1056/NEJMoa1710504.
Meunier et al., Drug-Induced Liver Injury: Biomarkers, Requirements, Candidates, and Validation. Front Pharmacol. Dec. 11, 2019;10:1482. doi: 10.3389/fphar.2019.01482.
Miccio et al., Novel genome-editing-based approaches to treat motor neuron diseases: Promises and challenges. Mol Ther. Jan. 5, 2022;30(1):47-53. doi: 10.1016/j.ymthe.2021.04.003. Epub Apr. 3, 2021.
Michaux et al., A spliced antigenic peptide comprising a single spliced amino acid is produced in the proteasome by reverse splicing of a longer peptide fragment followed by trimming. J Immunol. Feb. 15, 2014;192(4):1962-71. doi: 10.4049/jimmunol.1302032. Epub Jan. 22, 2014.
Milone et al., Clinical use of lentiviral vectors. Leukemia. Jul. 2018;32(7):1529-1541. doi: 10.1038/s41375-018-0106-0. Epub Mar. 22, 2018.
Mingozzi, F., Immunogenicity: A Matter of Sensitivity. Mol Ther. Oct. 3, 2018;26(10):2335-2336. doi: 10.1016/j.ymthe.2018.09.001. Epub Sep. 18, 2018.
Misra et al., An enzymatically active chimeric HIV-1 reverse transcriptase (RT) with the RNase-H domain of murine leukemia virus RT exists as a monomer. J Biol Chem. Apr. 17, 1998;273(16):9785-9. doi: 10.1074/jbc.273.16.9785.
Momose et al., Diving into marine genomics with CRISPR/Cas9 systems. Mar Genomics. Dec. 2016;30:55-65. doi: 10.1016/j.margen.2016.10.003. Epub Oct. 12, 2016.
Morel et al., A tyrosinase peptide presented by HLA-B35 is recognized on a human melanoma by autologous cytotoxic T lymphocytes. Int J Cancer. Dec. 10, 1999;83(6):755-9. doi: 10.1002/(sici)1097-0215(19991210)83:6<755::aid-ijc10>3.0.co;2-s.
Morrison et al., The developing toolkit of continuous directed evolution. Nat Chem Biol. Jun. 2020;16(6):610-619. doi: 10.1038/s41589-020-0532-y. Epub May 22, 2020.
Mselli-Lakhal et al., Gene transfer system derived from the caprine arthritis-encephalitis lentivirus. J Virol Methods. Sep. 2006;136(1-2):177-84. doi: 10.1016/j.jviromet.2006.05.006. Epub Jun. 21, 2006.
Mullally et al., 5' modifications to CRISPR-Cas9 gRNA can change the dynamics and size of R-loops and inhibit DNA cleavage. Nucleic Acids Res. Jul. 9, 2020;48(12):6811-6823. doi: 10.1093/nar/gkaa477.
Murawski et al., Newcastle disease virus-like particles containing respiratory syncytial virus G protein induced protection in BALB/c mice, with no evidence of immunopathology. J Virol. Jan. 2010;84(2):1110-23. doi: 10.1128/JVI.01709-09. Epub Nov. 4, 2009.
Musunuru et al., In vivo CRISPR base editing of PCSK9 durably lowers cholesterol in primates. Nature. May 2021;593(7859):429-434. doi: 10.1038/s41586-021-03534-y. Epub May 19, 2021.
Naryshkin et al., Motor neuron disease. SMN2 splicing modifiers improve motor function and longevity in mice with spinal muscular atrophy. Science. Aug. 8, 2014;345(6197):688-93. doi: 10.1126/science.1250127.
Naskalska et al., Virus Like Particles as Immunogens and Universal Nanocarriers. Pol J Microbiol. 2015;64(1):3-13.
Nawaz et al., Extracellular Vesicles, Tunneling Nanotubes, and Cellular Interplay: Synergies and Missing Links. Front Mol Biosci. Jul. 18, 2017;4:50. doi: 10.3389/fmolb.2017.00050.
Negre et al., Characterization of novel safe lentiviral vectors derived from simian immunodeficiency virus (SIVmac251) that efficiently transduce mature human dendritic cells. Gene Ther. Oct. 2000;7(19):1613-23. doi: 10.1038/sj.gt.3301292.
Nelson et al., Engineered pegRNAs improve prime editing efficiency. Nat Biotechnol. Mar. 2022;40(3):402-410. doi: 10.1038/s41587-

(56) References Cited

OTHER PUBLICATIONS 021-01039-7. Epub Oct. 4, 2021. Erratum in: Nat Biotechnol. Mar. 2022;40(3):432. doi: 10.1038/s41587-021-01175-0 and Supplemental Information. 15 pages.
Nesbitt, Targeted Intracellular Therapeutic Delivery Using Liposomes Formulated with Multifunctional FAST proteins. Electronic Thesis and Dissertation Repository. The University of Western Ontario. 2012. 126 pages.
Neugebauer et al., Evolution of an adenine base editor into a small, efficient cytosine base editor with low off-target activity. Nat Biotechnol. May 2023;41(5):673-685. doi: 10.1038/s41587-022-01533-6. Epub Nov. 10, 2022.
Newby et al., In vivo somatic cell base editing and prime editing. Mol Ther. Nov. 3, 2021;29(11):3107-3124. doi: 10.1016/j.ymthe.2021.09.002. Epub Sep. 10, 2021.
Nguyen Tran et al., Engineering domain-inlaid SaCas9 adenine base editors with reduced RNA off-targets and increased on-target DNA editing. Nat Commun. Sep. 25, 2020;11(1):4871. doi: 10.1038/s41467-020-18715-y.
Niemeyer, C.M., Semisynthetic DNA-protein conjugates for biosensing and nanofabrication. Angew Chem Int Ed Engl. Feb. 8, 2010;49(7):1200-16. doi: 10.1002/anie.200904930.
Niu et al., Inactivation of porcine endogenous retrovirus in pigs using CRISPR-Cas9. Science. Sep. 22, 2017;357(6357): 1303-1307. doi: 10.1126/science.aan4187. Epub Aug. 10, 2017.
Noppen et al., Naturally processed and concealed HLA-A2.1-restricted epitopes from tumor-associated antigen tyrosinase-related protein-2. Int J Cancer. Jul. 15, 2000;87(2):241-6.
Nowak et al., Ty3 reverse transcriptase complexed with an RNA-DNA hybrid shows structural and functional asymmetry. Nat Struct Mol Biol. Apr. 2014;21(4):389-96. doi: 10.1038/nsmb.2785. Epub Mar. 9, 2014. Author Manuscript, 22 pages.
Nukaya et al., Identification of HLA-A24 epitope peptides of carcinoembryonic antigen which induce tumor-reactive cytotoxic T lymphocyte. Int J Cancer. Jan. 5, 1999;80(1):92-7. doi: 10.1002/(sici) 1097-0215(19990105)80:1<92::aid-ijc18>3.0.co;2-m.
Ogasawara et al., Recombinant viral-like particles of parvovirus B19 as antigen carriers of anthrax protective antigen. In Vivo. May-Jun. 2006;20(3):319-24.
Ohminami et al., HLA class I-restricted lysis of leukemia cells by a CD8(+) cytotoxic T-lymphocyte clone specific for WT1 peptide. Blood. Jan. 1, 2000;95(1):286-93.
Oka et al., WT1 peptide vaccine for the treatment of cancer. Curr Opin Immunol. Apr. 2008;20(2):211-20. doi: 10.1016/j.coi.2008.04.009. Epub May 24, 2008.
Olsen, J.C., Gene transfer vectors derived from equine infectious anemia virus. Gene Ther. Nov. 1998;5(11):1481-7. doi: 10.1038/sj.gt.3300768.
Olson et al., HLA-A2-restricted T-cell epitopes specific for prostatic acid phosphatase. Cancer Immunol Immunother. Jun. 2010;59(6):943-53. doi: 10.1007/s00262-010-0820-6. Epub Feb. 6, 2010.
Osen et al., Screening of human tumor antigens for CD4 T cell epitopes by combination of HLA-transgenic mice, recombinant adenovirus and antigen peptide libraries. PLoS One. Nov. 30, 2010;5(11):e14137. doi: 10.1371/journal.pone.0014137.
Pan et al., Biodistribution and toxicity studies of VSVG-pseudotyped lentiviral vector after intravenous administration in mice with the observation of in vivo transduction of bone marrow. Mol Ther. Jul. 2002;6(1):19-29. doi: 10.1006/mthe.2002.0630.
Pan et al., Identification of a nuclear localization signal in OCT4 and generation of a dominant negative mutant by its ablation. J Biol Chem. Aug. 27, 2004;279(35):37013-20. doi: 10.1074/jbc.M405117200. Epub Jun. 24, 2004.
Pang et al., Retinal degeneration 12 (rd12): a new, spontaneously arising mouse model for human Leber congenital amaurosis (LCA). Mol Vis. Feb. 28, 2005;11:152-62.
Park et al., Targeted mutagenesis in mouse cells and embryos using an enhanced prime editor. Genome Biol. Jun. 3, 2021;22(1):170. doi: 10.1186/s13059-021-02389-w.
Parkhurst et al., Identification of a shared HLA-A*0201-restricted T-cell epitope from the melanoma antigen tyrosinase-related protein 2 (TRP2). Cancer Res. Nov. 1, 1998;58(21):4895-901.
Parkhurst et al., Induction of CD4+ Th1 lymphocytes that recognize known and novel class II MHC restricted epitopes from the melanoma antigen gp100 by stimulation with recombinant protein. J Immunother. Mar.-Apr. 2004;27(2):79-91. doi: 10.1097/00002371-200403000-00001. Author Manuscript. 22 pages.
Parr-Brownlie et al., Lentiviral vectors as tools to understand central nervous system biology in mammalian model organisms. Front Mol Neurosci. May 18, 2015;8:14. doi: 10.3389/fnmol.2015.00014.
Paschen et al., Detection of spontaneous CD4+ T-cell responses in melanoma patients against a tyrosinase-related protein-2-derived epitope identified in HLA-DRB1*0301 transgenic mice. Clin Cancer Res. Jul. 15, 2005;11(14):5241-7. doi: 10.1158/1078-0432.CCR-05-0170.
Pastuzyn et al., The Neuronal Gene Arc Encodes a Repurposed Retrotransposon Gag Protein that Mediates Intercellular RNA Transfer. Cell. Jan. 11, 2018;172(1-2):275-288.e18. doi: 10.1016/j.cell.2017.12.024. Erratum in: Cell. Mar. 22, 2018;173(1):275. doi: 10.1016/j.cell.2018.03.024.
Pavlov et al., Roles of DNA polymerases in replication, repair, and recombination in eukaryotes. Int Rev Cytol. 2006;255:41-132. doi: 10.1016/S0074-7696(06)55002-8.
Petri et al., CRISPR prime editing with ribonucleoprotein complexes in zebrafish and primary human cells. Nat Biotechnol. Feb. 2022;40(2):189-193. doi: 10.1038/s41587-021-00901-y. Epub Apr. 29, 2021. Erratum in: Nat Biotechnol. May 13, 2021.
Pinilla et al., Combinatorial peptide libraries as an alternative approach to the identification of ligands for tumor-reactive cytolytic T lymphocytes. Cancer Res. Jul. 1, 2001;61(13):5153-60.
Pinilla-Ibarz et al., Improved human T-cell responses against synthetic HLA-0201 analog peptides derived from the WT1 oncoprotein. Leukemia. Nov. 2006;20(11):2025-33. doi: 10.1038/sj.leu.2404380. Epub Aug. 31, 2006.
Podbilewicz, Virus and cell fusion mechanisms. Annu Rev Cell Dev Biol. 2014;30:111-39. doi: 10.1146/annurev-cellbio-101512-122422. Epub Jun. 27, 2014.
Porter et al., Therapeutic promise of engineered nonsense suppressor tRNAs. Wiley Interdiscip Rev RNA. Jul. 2021;12(4):e1641. doi: 10.1002/wrna.1641. Epub Feb. 10, 2021.
Prather et al., De novo biosynthetic pathways: rational design of microbial chemical factories. Curr Opin Biotechnol. Oct. 2008; 19(5):468-74. doi: 10.1016/j.copbio.2008.07.009. Epub Sep. 5, 2008.
Puppo et al., Retinal transduction profiles by high-capacity viral vectors. Gene Ther. Oct. 2014;21(10):855-65. doi: 10.1038/gt.2014.57. Epub Jul. 3, 2014.
Qi et al., Repurposing CRISPR as an RNA-guided platform for sequence-specific control of gene expression. Cell. Feb. 28, 2013;152(5):Supplementary Material. doi: 10.1016/j.cell.2013.02.022. 4 pages.
Quan et al., Influenza M1 VLPs containing neuraminidase induce heterosubtypic cross-protection. Virology. Sep. 1, 2012;430(2):127-35. doi: 10.1016/j.virol.2012.05.006. Epub Jun. 2, 2012.
Raaijmakers et al., CRISPR/Cas Applications in Myotonic Dystrophy: Expanding Opportunities. Int J Mol Sci. Jul. 27, 2019;20(15):3689. doi: 10.3390/ijms20153689.
Raguram et al., Therapeutic in vivo delivery of gene editing agents. Cell. Jul. 21, 2022;185(15):2806-2827. doi: 10.1016/j.cell.2022.03.045. Epub Jul. 6, 2022.
Ramiro et al., Transcription enhances AID-mediated cytidine deamination by exposing single-stranded DNA on the nontemplate strand. Nat Immunol. May 2003;4(5):452-6. doi: 10.1038/ni920.
Rao et al., Large-Scale Phenome-Wide Association Study of PCSK9 Variants Demonstrates Protection Against Ischemic Stroke. Circ Genom Precis Med. Jul. 2018;11(7):e002162. doi: 10.1161/CIRCGEN.118.002162.
Rasmussen et al., Characterization of virus-like particles produced by a recombinant baculovirus containing the gag gene of the bovine immunodeficiency-like virus. Virology. Oct. 1990;178(2):435-51. doi: 10.1016/0042-6822(90)90341-n.

(56) References Cited

OTHER PUBLICATIONS

Remington et al., Complete nucleotide sequence of a neuropathogenic variant of Friend murine leukemia virus PVC-211. Nucleic Acids Res. Jun. 25, 1992;20(12):3249. doi: 10.1093/nar/20.12.3249.
Renner et al., Intact Viral Particle Counts Measured by Flow Virometry Provide Insight into the Infectivity and Genome Packaging Efficiency of Moloney Murine Leukemia Virus. J Virol. Jan. 6, 2020;94(2):e01600-19. doi: 10.1128/JVI.01600-19.
Riddle et al., Frameshift suppression: a nucleotide addition in the anticodon of a glycine transfer RNA. Nat New Biol. Apr. 25, 1973;242(121):230-4. doi: 10.1038/newbio242230a0.
Riddle et al., Frameshift suppressors. II. Genetic mapping and dominance studies. J Mol Biol. May 28, 1972;66(3):483-93. doi: 10.1016/0022-2836(72)90428-7.
Riddle et al., Suppressors of frameshift mutations in *Salmonella typhimurium*. J Mol Biol. Nov. 28, 1970;54(1):131-44. doi: 10.1016/0022-2836(70)90451-1.
Riley et al., Identification of a new shared HLA-A2.1 restricted epitope from the melanoma antigen tyrosinase. J Immunother. May-Jun. 2001;24(3):212-20.
Rimoldi et al., Efficient simultaneous presentation of NY-ESO-1/LAGE-1 primary and nonprimary open reading frame-derived CTL epitopes in melanoma. J Immunol. Dec. 15, 2000;165(12):7253-61. doi: 10.4049/jimmunol. 165.12.7253.
Robbins et al., Multiple HLA class II-restricted melanocyte differentiation antigens are recognized by tumor-infiltrating lymphocytes from a patient with melanoma. J Immunol. Nov. 15, 2002;169(10):6036-47. doi: 10.4049/jimmunol.169.10.6036.
Robbins et al., The intronic region of an incompletely spliced gp100 gene transcript encodes an epitope recognized by melanoma-reactive tumor-infiltrating lymphocytes. J Immunol. Jul. 1, 1997;159(1):303-8.
Rohovie et al., Virus-like particles: Next-generation nanoparticles for targeted therapeutic delivery. Bioeng Transl Med. Jan. 19, 2017;2(1):43-57. doi: 10.1002/btm2.10049.
Romero et al., Exploring protein fitness landscapes by directed evolution. Nat Rev Mol Cell Biol. Dec. 2009;10(12):866-76. doi: 10.1038/nrm2805.
Rosenberg et al., Immunologic and therapeutic evaluation of a synthetic peptide vaccine for the treatment of patients with metastatic melanoma. Nat Med. Mar. 1998;4(3):321-7. doi: 10.1038/nm0398-321.
Rothgangl et al., In vivo adenine base editing of PCSK9 in macaques reduces LDL cholesterol levels. Nat Biotechnol. Aug. 2021;39(8):949-957. doi: 10.1038/s41587-021-00933-4. Epub May 19, 2021.
Rubio-Godoy et al., Toward synthetic combinatorial peptide libraries in positional scanning format (PS-SCL)-based identification of CD8+ Tumor-reactive T-Cell Ligands: a comparative analysis of PS-SCL recognition by a single tumor-reactive CD8+ cytolytic T-lymphocyte clone. Cancer Res. Apr. 1, 2002;62(7):2058-63.
Ruiz et al., Identification and characterization of a T-helper peptide from carcinoembryonic antigen. Clin Cancer Res. Apr. 15, 2004;10(8):2860-7. doi: 10.1158/1078-0432.ccr-03-0476.
Rusk, Cas9 and the importance of asymmetry. Nat Methods. Apr. 2016;13(4):286-7. doi: 10.1038/nmeth.3826.
Ryan et al., Phosphonoacetate Modifications Enhance the Stability and Editing Yields of Guide RNAs for Cas9 Editors. Biochemistry. Dec. 19, 2023;62(24):3512-3520. doi: 10.1021/acs.biochem. 1c00768. Epub Apr. 18, 2022.
Sadowski et al., The sequence-structure relationship and protein function prediction. Curr Opin Struct Biol. Jun. 2009;19(3):357-62. doi: 10.1016/j.sbi.2009.03.008. Epub May 4, 2009.
Saenger et al., Improved tumor immunity using anti-tyrosinase related protein-1 monoclonal antibody combined with DNA vaccines in murine melanoma. Cancer Res. Dec. 1, 2008;68(23):9884-91. doi: 10.1158/0008-5472.CAN-08-2233. Author Manuscript. 19 pages.
Saenz et al., Feline immunodeficiency virus-based lentiviral vectors. Cold Spring Harb Protoc. Jan. 1, 2012;2012(1):71-6. doi: 10.1101/pdb.ip067579.
Saenz et al., Production, harvest, and concentration of feline immunodeficiency virus-based lentiviral vector from cells grown in CF10 or CF2 devices. Cold Spring Harb Protoc. Jan. 1, 2012;2012(1):118-23. doi: 10.1101/pdb.prot067546.
Sakuma et al., Multiplex genome engineering in human cells using all-in-one CRISPR/Cas9 vector system. Sci Rep. Jun. 23, 2014;4:5400. doi: 10.1038/srep05400.
Sanjana et al., Improved vectors and genome-wide libraries for CRISPR screening. Nat Methods. Aug. 2014;11(8):783-784. doi: 10.1038/nmeth.3047.
Sapir et al., Viral and developmental cell fusion mechanisms: conservation and divergence. Dev Cell. Jan. 2008;14(1):11-21. doi: 10.1016/j.devcel.2007.12.008.
Schellekens, Bioequivalence and the immunogenicity of biopharmaceuticals. Nat Rev Drug Discov. Jun. 2002;1(6):457-62. doi: 10.1038/nrd818.
Schene et al., Prime editing for functional repair in patient-derived disease models. Nat Commun. Oct. 23, 2020;11(1):5352. doi: 10.1038/s41467-020-19136-7.
Schneider et al., MuLV IN mutants responsive to HDAC inhibitors enhance transcription from unintegrated retroviral DNA. Virology. May 10, 2012;426(2):188-96. doi: 10.1016/j.virol.2012.01.034. Epub Feb. 23, 2012.
Schneider et al., Overlapping peptides of melanocyte differentiation antigen Melan-A/MART-1 recognized by autologous cytolytic T lymphocytes in association with HLA-B45.1 and HLA-A2.1. Int J Cancer. Jan. 30, 1998;75(3):451-8. doi: 10.1002/(sici)1097-0215(19980130)75:3<451::aid-ijc20>3.0.co;2-a.
Scholefield et al., Prime editing—an update on the field. Gene Ther. Aug. 2021;28(7-8):396-401. doi: 10.1038/s41434-021-00263-9. Epub May 24, 2021.
Score Results for US 2014-0186919 A1 to Zhang et al. Aug. 28, 2014. 3 pages.
Seffernick et al., Melamine deaminase and atrazine chlorohydrolase: 98 percent identical but functionally different. J Bacteriol. Apr. 2001;183(8):2405-10. doi: 10.1128/JB.183.8.2405-2410.2001.
Segel et al., Mammalian retrovirus-like protein PEG10 packages its own mRNA and can be pseudotyped for mRNA delivery. Science. Aug. 20, 2021;373(6557):882-889. doi: 10.1126/science.abg6155.
Semple et al., Brain development in rodents and humans: Identifying benchmarks of maturation and vulnerability to injury across species. Prog Neurobiol. Jul.-Aug. 2013;106-107:1-16. doi: 10.1016/j.pneurobio.2013.04.001. Epub Apr. 11, 2013.
Sensi et al., Identification of a novel gp100/pMel17 peptide presented by HLA-A*6801 and recognized on human melanoma by cytolytic T cell clones. Tissue Antigens. Apr. 2002;59(4):273-9. doi: 10.1034/j.1399-0039.2002.590404.x.
Serreze et al., Major histocompatibility complex class I-deficient NOD-B2mnull mice are diabetes and insulitis resistant. Diabetes. Mar. 1994;43(3):505-9. doi: 10.2337/diab.43.3.505.
Shalaby et al., Tissue-Specific Delivery of CRISPR Therapeutics: Strategies and Mechanisms of Non-Viral Vectors. Int J Mol Sci. Oct. 5, 2020;21(19):7353. doi: 10.3390/ijms21197353.
Shams et al., Comprehensive deletion landscape of CRISPR-Cas9 identifies minimal RNA-guided DNA-binding modules. Nat Commun. Sep. 27, 2021;12(1):5664. doi: 10.1038/s41467-021-25992-8.
Shang et al., The spontaneous CD8+ T-cell response to HLA-A2-restricted NY-ESO-1b peptide in hepatocellular carcinoma patients. Clin Cancer Res. Oct. 15, 2004;10(20):6946-55. doi: 10.1158/1078-0432.CCR-04-0502.
Sharma et al., Noninfectious virus-like particles produced by Moloney murine leukemia virus-based retrovirus packaging cells deficient in viral envelope become infectious in the presence of lipofection reagents. Proc Natl Acad Sci U S A. Sep. 30, 1997;94(20):10803-8. doi: 10.1073/pnas.94.20.10803.
Shellenberger et al., A recombinant polypeptide extends the in vivo half-life of peptides and proteins in a tunable manner. Nat Biotechnol. Dec. 2009;27(12):1186-90. doi: 10.1038/nbt.1588.
Shen et al., Activation-induced cytidine deaminase (AID) can target both DNA strands when the DNA is supercoiled. Proc Natl Acad Sci U S A. Aug. 31, 2004;101(35):12997-3002. doi: 10.1073/pnas.0404974101. Epub Aug. 24, 2004.

(56) References Cited

OTHER PUBLICATIONS

Shen et al., Identification of a MHC class-II restricted epitope in carcinoembryonic antigen. Cancer Immunol Immunother. May 2004;53(5):391-403. doi: 10.1007/s00262-003-0455-y. Epub Nov. 18, 2003.
Shim et al., Nonviral Delivery Systems for Cancer Gene Therapy: Strategies and Challenges. Curr Gene Ther. 2018;18(1):3-20. doi: 10.2174/1566523218666180119121949.
Simon et al., Retrons and their applications in genome engineering. Nucleic Acids Res. Dec. 2, 2019;47(21):11007-11019. doi: 10.1093/nar/gkz865.
Singh et al., Protein Engineering Approaches in the Post-Genomic Era. Curr Protein Pept Sci. 2018;19(1):5-15. doi: 10.2174/1389203718666161117114243.
Skipper et al., An HLA-A2-restricted tyrosinase antigen on melanoma cells results from posttranslational modification and suggests a novel pathway for processing of membrane proteins. J Exp Med. Feb. 1, 1996;183(2):527-34. doi: 10.1084/jem.183.2.527.
Skipper et al., Delivering the Goods for Genome Engineering and Editing. Hum Gene Ther. Aug. 2015;26(8):486-97. doi: 10.1089/hum.2015.063.
Skipper et al., Shared epitopes for HLA-A3-restricted melanoma-reactive human CTL include a naturally processed epitope from Pmel-17/gp100. J Immunol. Dec. 1, 1996;157(11):5027-33.
Slansky et al., Enhanced antigen-specific antitumor immunity with altered peptide ligands that stabilize the MHC-peptide-TCR complex. Immunity. Oct. 2000;13(4):529-38. doi: 10.1016/s1074-7613(00)00052-2.
Slingluff et al., Clinical and immunologic results of a randomized phase II trial of vaccination using four melanoma peptides either administered in granulocyte-macrophage colony-stimulating factor in adjuvant or pulsed on dendritic cells. J Clin Oncol. Nov. 1, 2003;21(21):4016-26. doi: 10.1200/JCO.2003.10.005.
Slingluff et al., Immunologic and clinical outcomes of vaccination with a multiepitope melanoma peptide vaccine plus low-dose interleukin-2 administered either concurrently or on a delayed schedule. J Clin Oncol. Nov. 15, 2004;22(22):4474-85. doi: 10.1200/JCO.2004.10.212.
Sodi et al., RPE65-associated inherited retinal diseases: consensus recommendations for eligibility to gene therapy. Orphanet J Rare Dis. Jun. 4, 2021;16(1):257. doi: 10.1186/s13023-021-01868-4.
Song et al., Large-Fragment Deletions Induced by Cas9 Cleavage while Not in the BEs System. Mol Ther Nucleic Acids. Sep. 4, 2020;21:523-526. doi: 10.1016/j.omtn.2020.06.019. Epub Jun. 25, 2020.
Stadtmauer et al., CRISPR-engineered T cells in patients with refractory cancer. Science. Feb. 28, 2020;367(6481):eaba7365. doi: 10.1126/science.aba7365. Epub Feb. 6, 2020.
Stevens et al., Design of a Split Intein with Exceptional Protein Splicing Activity. J Am Chem Soc. Feb. 24, 2016;138(7):2162-5. doi: 10.1021/jacs.5b13528. Epub Feb. 8, 2016. Abstract Only. 1 page.
Studebaker et al., Depletion of uracil-DNA glycosylase activity is associated with decreased cell proliferation. Biochem Biophys Res Commun. Aug. 26, 2005;334(2):509-15. doi: 10.1016/j.bbrc.2005.06.118.
Suh et al., Publisher Correction: Restoration of visual function in adult mice with an inherited retinal disease via adenine base editing. Nat Biomed Eng. Nov. 2020;4(11):1119. doi: 10.1038/s41551-020-00652-2. Erratum for: Nat Biomed Eng. Oct. 19, 2020.
Suzuki et al., FDA approval summary for lonafarnib (Zokinvy) for the treatment of Hutchinson-Gilford progeria syndrome and processing-deficient progeroid laminopathies. Genet Med. Feb. 2023;25(2):100335. doi: 10.1016/j.gim.2022.11.003. Epub Dec. 12, 2022.
Swiech et al., In vivo interrogation of gene function in the mammalian brain using CRISPR-Cas9. Nat Biotechnol. Jan. 2015;33(1):102-6. doi: 10.1038/nbt.3055. Epub Oct. 19, 2014. Author Manuscript. 22 pages.
Taha et al., Delivery of CRISPR-Cas tools for in vivo genome editing therapy: Trends and challenges. J Control Release. Feb. 2022;342:345-361. doi: 10.1016/j.jconrel.2022.01.013. Epub Jan. 10, 2022.
Tang et al., Identification of Dehalobacter reductive dehalogenases that catalyse dechlorination of chloroform, 1,1,1-trichloroethane and 1,1-dichloroethane. Philos Trans R Soc Lond B Biol Sci. Mar. 11, 2013;368(1616):20120318. doi: 10.1098/rstb.2012.0318.
Tang et al., The *Arabidopsis* TRM61/TRM6 complex is a bona fide tRNA N1-methyladenosine methyltransferase. J Exp Bot. May 30, 2020;71(10):3024-3036. doi: 10.1093/jxb/eraa100.
Tangri et al., Structural features of peptide analogs of human histocompatibility leukocyte antigen class I epitopes that are more potent and immunogenic than wild-type peptide. J Exp Med. Sep. 17, 2001;194(6):833-46. doi: 10.1084/jem.194.6.833.
Taylor, Ocular immune privilege. Eye (Lond). Oct. 2009;23(10):1885-9. doi: 10.1038/eye.2008.382. Epub Jan. 9, 2009.
Thakore et al., Highly specific epigenome editing by CRISPR-Cas9 repressors for silencing of distal regulatory elements. Nat Methods. Dec. 2015;12(12):1143-9. doi: 10.1038/nmeth.3630. Epub Oct. 26, 2015.
Thandapani et al., Valine tRNA levels and availability regulate complex I assembly in leukaemia. Nature. Jan. 2022;601(7893):428-433. doi: 10.1038/s41586-021-04244-1. Epub Dec. 22, 2021.
Thorne et al., In vivo diffusion analysis with quantum dots and dextrans predicts the width of brain extracellular space. Proc Natl Acad Sci U S A. Apr. 4, 2006;103(14):5567-72. doi: 10.1073/pnas.0509425103. Epub Mar. 27, 2006.
Tokuriki et al., Stability effects of mutations and protein evolvability. Curr Opin Struct Biol. Oct. 2009;19(5):596-604. doi: 10.1016/j.sbi.2009.08.003. Epub Sep. 16, 2009.
Tomé-Amat et al., Secreted production of assembled Norovirus virus-like particles from Pichia pastoris. Microb Cell Fact. Sep. 10, 2014;13:134. doi: 10.1186/s12934-014-0134-z.
Topalian et al., Melanoma-specific CD4+ T cells recognize nonmutated HLA-DR-restricted tyrosinase epitopes. J Exp Med. May 1, 1996;183(5):1965-71. doi: 10.1084/jem.183.5.1965.
Toro et al., Comprehensive phylogenetic analysis of bacterial reverse transcriptases. PLoS One. Nov. 25, 2014;9(11):e114083. doi: 10.1371/journal.pone.0114083.
Touloukian et al., Expression of a "self-"antigen by human tumor cells enhances tumor antigen-specific CD4(+) T-cell function. Cancer Res. Sep. 15, 2002;62(18):5144-7. Author Manuscript. 11 pages.
Touloukian et al., Identification of a MHC class II-restricted human gp100 epitope using DR4-IE transgenic mice. J Immunol. Apr. 1, 2000;164(7):3535-42. doi: 10.4049/jimmunol.164.7.3535.
Touloukian et al., Normal tissue depresses while tumor tissue enhances human T cell responses in vivo to a novel self/tumor melanoma antigen, OA1. J Immunol. Feb. 1, 2003;170(3):1579-85. doi: 10.4049/jimmunol.170.3.1579.
Tözsér, Comparative studies on retroviral proteases: substrate specificity. Viruses. Jan. 2010;2(1):147-165. doi: 10.3390/v2010147. Epub Jan. 14, 2010.
Trojan et al., Generation of cytotoxic T lymphocytes against native and altered peptides of human leukocyte antigen-A*0201 restricted epitopes from the human epithelial cell adhesion molecule. Cancer Res. Jun. 15, 2001;61(12):4761-5.
Tsai et al., Identification of subdominant CTL epitopes of the GP100 melanoma-associated tumor antigen by primary in vitro immunization with peptide-pulsed dendritic cells. J Immunol. Feb. 15, 1997;158(4):1796-802.
Tsang et al., A human cytotoxic T-lymphocyte epitope and its agonist epitope from the nonvariable number of tandem repeat sequence of MUC-1. Clin Cancer Res. Mar. 15, 2004;10(6):2139-49. doi: 10.1158/1078-0432.ccr-1011-03.
Tsang et al., Generation of human cytotoxic T cells specific for human carcinoembryonic antigen epitopes from patients immunized with recombinant vaccinia-CEA vaccine. J Natl Cancer Inst. Jul. 5, 1995;87(13):982-90. doi: 10.1093/jnci/87.13.982.
Tsuboi et al., Enhanced induction of human WT1-specific cytotoxic T lymphocytes with a 9-mer WT1 peptide modified at HLA-A*2402-binding residues. Cancer Immunol Immunother. Dec. 2002;51(11-12):614-20. doi: 10.1007/s00262-002-0328-9. Epub Oct. 18, 2002.

(56) References Cited

OTHER PUBLICATIONS

Tuorto et al., Genome recoding by tRNA modifications. Open Biol. Dec. 2016;6(12):160287. doi: 10.1098/rsob.160287.
Turchiano et al., Quantitative evaluation of chromosomal rearrangements in gene-edited human stem cells by CAST-Seq. Cell Stem Cell. Jun. 3, 2021;28(6):1136-1147.e5. doi: 10.1016/j.stem.2021.02.002. Epub Feb. 23, 2021.
Tycko et al., Methods for Optimizing CRISPR-Cas9 Genome Editing Specificity. Mol Cell. Aug. 4, 2016;63(3):355-70. doi: 10.1016/j.molcel.2016.07.004.
Urano et al., Substitution of the myristoylation signal of human immunodeficiency virus type 1 Pr55Gag with the phospholipase C-deltal pleckstrin homology domain results in infectious pseudovirion production. J Gen Virol. Dec. 2008;89(Pt 12):3144-3149. doi: 10.1099/vir.0.2008/004820-0.
Valmori et al., Analysis of the cytolytic T lymphocyte response of melanoma patients to the naturally HLA-A*0201-associated tyrosinase peptide 368-376. Cancer Res. Aug. 15, 1999;59(16):4050-5.
Valmori et al., Enhanced generation of specific tumor-reactive CTL in vitro by selected Melan-A/MART-1 immunodominant peptide analogues. J Immunol. Feb. 15, 1998;160(4):1750-8.
Valmori et al., Naturally occurring human lymphocyte antigen-A2 restricted CD8+ T-cell response to the cancer testis antigen NY-ESO-1 in melanoma patients. Cancer Res. Aug. 15, 2000;60(16):4499-506.
Van Essen et al., CRISPR-Cas Gene Perturbation and Editing in Human Induced Pluripotent Stem Cells. CRISPR J. Oct. 2021;4(5):634-655. doi: 10.1089/crispr.2021.0063. Epub Sep. 28, 2021.
Vigneron et al., A peptide derived from melanocytic protein gp100 and presented by HLA-B35 is recognized by autologous cytolytic T lymphocytes on melanoma cells. Tissue Antigens. Feb. 2005;65(2):156-62. doi: 10.1111/j.1399-0039.2005.00365.x.
Vigneron et al., An antigenic peptide produced by peptide splicing in the proteasome. Science. Apr. 23, 2004;304(5670):587-90. doi: 10.1126/science.1095522.
Visseren et al., Affinity, specificity and T-cell-receptor diversity of melanoma-specific CTL generated in vitro against a single tyrosinase epitope. Int J Cancer. Sep. 17, 1997;72(6):1122-8. doi: 10.1002/(sici)1097-0215(19970917)72:6<1122::aid-ijc30>3.0.co;2-3.
Voelkel et al., Protein transduction from retroviral Gag precursors. Proc Natl Acad Sci U S A. Apr. 27, 2010;107(17):7805-10. doi: 10.1073/pnas.0914517107. Epub Apr. 12, 2010.
Voisset et al., Phylogeny of a novel family of human endogenous retrovirus sequences, HERV-W, in humans and other primates. AIDS Res Hum Retroviruses. Nov. 20, 1999;15(17):1529-33. doi: 10.1089/088922299309810.
Volpe et al., Alternative BCR/ABL splice variants in Philadelphia chromosome-positive leukemias result in novel tumor-specific fusion proteins that may represent potential targets for immunotherapy approaches. Cancer Res. Jun. 1, 2007;67(11):5300-7. doi: 10.1158/0008-5472.CAN-06-3737.
Voutev et al., Bxb1 phage recombinase assists genome engineering in *Drosophila melanogaster*. Biotechniques. Jan. 1, 2017;62(1):37-38. doi: 10.2144/000114494.
Walpita et al., Mammalian Cell-Derived Respiratory Syncytial Virus-Like Particles Protect the Lower as well as the Upper Respiratory Tract. PLoS One. Jul. 14, 2015;10(7):e0130755. doi: 10.1371/journal.pone.0130755.
Walton et al., Spontaneous CD8 T cell responses against the melanocyte differentiation antigen RAB38/NY-MEL-1 in melanoma patients. J Immunol. Dec. 1, 2006;177(11):8212-8. doi: 10.4049/jimmunol.177.11.8212.
Wang et al., Characterization of an MPS I-H knock-in mouse that carries a nonsense mutation analogous to the human IDUA-W402X mutation. Mol Genet Metab. Jan. 2010;99(1):62-71. doi: 10.1016/j.ymgme.2009.08.002. Erratum in: Mol Genet Metab. Apr. 2010;99(4):439.
Wang et al., CRISPR/Cas9 in Genome Editing and Beyond. Annu Rev Biochem. Jun. 2, 2016;85:227-64. doi: 10.1146/annurev-biochem-060815-014607. Epub Apr. 25, 2016.
Wang et al., CRISPR-Based Therapeutic Genome Editing: Strategies and In Vivo Delivery by AAV Vectors. Cell. Apr. 2, 2020;181(1):136-150. doi: 10.1016/j.cell.2020.03.023.
Wang et al., Influence of the polyanion on the physico-chemical properties and biological activities of polyanion/DNA/polycation ternary polyplexes. Acta Biomater. Aug. 2012;8(8):3014-26. doi: 10.1016/j.actbio.2012.04.034. Epub Apr. 27, 2012.
Wang et al., Recognition of an antigenic peptide derived from tyrosinase-related protein-2 by CTL in the context of HLA-A31 and -A33. J Immunol. Jan. 15, 1998;160(2):890-7.
Wang et al., Recognition of breast cancer cells by CD8+ cytotoxic T-cell clones specific for NY-BR-1. Cancer Res. Jul. 1, 2006;66(13):6826-33. doi: 10.1158/0008-5472.CAN-05-3529.
Wang et al., Utilization of an alternative open reading frame of a normal gene in generating a novel human cancer antigen. J Exp Med. Mar. 1, 1996;183(3):1131-40. doi: 10.1084/jem.183.3.1131.
Wang et al., Virus-like particles for the prevention of human papillomavirus-associated malignancies. Expert Rev Vaccines. Feb. 2013;12(2):129-41. doi: 10.1586/erv.12.151. Author Manuscript, 22 pages.
Webber et al., Highly efficient multiplex human T cell engineering without double-strand breaks using Cas9 base editors. Nat Commun. Nov. 19, 2019;10(1):5222. doi: 10.1038/s41467-019-13007-6. Erratum in: Nat Commun. Dec. 6, 2019;10(1):5659. doi: 10.1038/s41467-019-13778-y.
Wei et al., Systemic nanoparticle delivery of CRISPR-Cas9 ribonucleoproteins for effective tissue specific genome editing. Nat Commun. Jun. 26, 2020;11(1):3232. doi: 10.1038/s41467-020-17029-3.
Wheeler et al., Proteomics analysis of cellular components in lentiviral vector production using Gel-LC-MS/MS. Proteomics Clin Appl. Feb. 2007;1(2):224-30. doi: 10.1002/prca.200600522. Epub Jan. 22, 2007.
Willis et al., Compact zinc finger base editors that edit mitochondrial or nuclear DNA in vitro and in vivo. Nat Commun. Nov. 23, 2022;13(1):7204. doi: 10.1038/s41467-022-34784-7.
Witkowski et al., Conversion of a beta-ketoacyl synthase to a malonyl decarboxylase by replacement of the active-site cysteine with glutamine. Biochemistry. Sep. 7, 1999;38(36):11643-50. doi: 10.1021/bi990993h.
Wölfel et al., Two tyrosinase nonapeptides recognized on HLA-A2 melanomas by autologous cytolytic T lymphocytes. Eur J Immunol. Mar. 1994;24(3):759-64. doi: 10.1002/eji.1830240340.
Worgall et al., Treatment of late infantile neuronal ceroid lipofuscinosis by CNS administration of a serotype 2 adeno-associated virus expressing CLN2 cDNA. Hum Gene Ther. May 2008; 19(5):463-74. doi: 10.1089/hum.2008.022.
Wu et al., Effect of genome size on AAV vector packaging. Mol Ther. Jan. 2010;18(1):80-6. doi: 10.1038/mt.2009.255. Epub Nov. 10, 2009.
Xu et al., Cas9-based tools for targeted genome editing and transcriptional control. Appl Environ Microbiol. Mar. 2014;80(5):1544-52. doi: 10.1128/AEM.03786-13. Epub Jan. 3, 2014.
Xu et al., Engineered miniature CRISPR-Cas system for mammalian genome regulation and editing. Mol Cell. Oct. 21, 2021;81(20):4333-4345.e4. doi: 10.1016/j.molcel.2021.08.008. Epub Sep. 3, 2021.
Xu et al., Sequence and structural analyses of nuclear export signals in the NESdb database. Mol Biol Cell. Sep. 2012;23(18):3677-93. doi: 10.1091/mbc.E12-01-0046. Epub Jul. 25, 2012.
Yang et al., HIV-1 virus-like particles produced by stably transfected *Drosophila* S2 cells: a desirable vaccine component. J Virol. Jul. 2012;86(14):7662-76. doi: 10.1128/JVI.07164-11. Epub May 2, 2012.
Yao et al., Engineered extracellular vesicles as versatile ribonucleoprotein delivery vehicles for efficient and safe CRISPR genome editing. J Extracell Vesicles. Mar. 2021;10(5):e12076. doi: 10.1002/jev2.12076. Epub Mar. 16, 2021.
Yee et al., A general method for the generation of high-titer, pantropic retroviral vectors: highly efficient infection of primary hepatocytes. Proc Natl Acad Sci U S A. Sep. 27, 1994;91(20):9564-8. doi: 10.1073/pnas.91.20.9564.

(56) References Cited

OTHER PUBLICATIONS

Yin et al., Optimizing genome editing strategy by primer-extension-mediated sequencing. Cell Discov. Mar. 26, 2019;5:18. doi: 10.1038/s41421-019-0088-8.
Yu et al., Poor immunogenicity of a self/tumor antigen derives from peptide-MHC-I instability and is independent of tolerance. J Clin Invest. Aug. 2004;114(4):551-9. doi: 10.1172/JCI21695.
Zarour et al., Melan-A/MART-1(51-73) represents an immunogenic HLA-DR4-restricted epitope recognized by melanoma-reactive CD4(+) T cells. Proc Natl Acad Sci U S A. Jan. 4, 2000;97(1):400-5. doi: 10.1073/pnas.97.1.400.
Zeltins, A., Construction and characterization of virus-like particles: a review. Mol Biotechnol. Jan. 2013;53(1):92-107. doi: 10.1007/s12033-012-9598-4.
Zeng et al., Therapeutic base editing of human hematopoietic stem cells. Nat Med. Apr. 2020;26(4):535-541. doi: 10.1038/s41591-020-0790-y. Epub Mar. 16, 2020.
Zhang et al., Adenine Base Editing In Vivo with a Single Adeno-Associated Virus Vector. BioRxiv. Dec. 13, 2021. DOI: 10.1101/2021.12.13.472434. Retrieved from https://www.biorxiv.org/content/10.1101/2021.12.13.472434v1.full on Aug. 1, 2023. 47 pages.
Zhang et al., Cell-specific targeting of lentiviral vectors mediated by fusion proteins derived from Sindbis virus, vesicular stomatitis virus, or avian sarcoma/leukosis virus. Retrovirology. Jan. 25, 2010;7:3. doi: 10.1186/1742-4690-7-3.
Zhang et al., CRISPR-Cpf1 correction of muscular dystrophy mutations in human cardiomyocytes and mice. Sci Adv. Apr. 12, 2017;3(4):e1602814. doi: 10.1126/sciadv.1602814.
Zhang et al., Morphology and ultrastructure of retrovirus particles. AIMS Biophys. 2015;2(3):343-369. doi: 10.3934/biophy.2015.3.343. Epub Aug. 18, 2015. Author Manuscript. 33 pages.
Zhang et al., Propagated Perturbations from a Peripheral Mutation Show Interactions Supporting WW Domain Thermostability. Structure. Nov. 6, 2018;26(11):1474-1485.e5. doi: 10.1016/j.str.2018.07.014. Epub Sep. 6, 2018.
Zhao et al., Glycosylase base editors enable C-to-A and C-to-G base changes. Nat Biotechnol. Jan. 2021;39(1):35-40. doi: 10.1038/s41587-020-0592-2. Epub Jul. 20, 2020. Erratum in: Nat Biotechnol. Jan. 2021;39(1):115. doi: 10.1038/s41587-020-0648-3.
Zhao et al., Study on p21 gene knock out in G401 cell line by using CRISPR/Cas9 system. Tianjin Med J. Oct. 2016;44(10):1190-1194.
Zheng et al., A flexible split prime editor using truncated reverse transcriptase improves dual-AAV delivery in mouse liver. Mol Ther. Mar. 2, 2022;30(3):1343-1351. doi: 10.1016/j.ymthe.2022.01.005. Epub Jan. 5, 2022.
Zhi et al., Dual-AAV delivering split prime editor system for in vivo genome editing. Mol Ther. Jan. 5, 2022;30(1):283-294 and Supplemental Info. doi: 10.1016/j.ymthe.2021.07.011. Epub Jul. 21, 2021. 35 pages.
Zhong et al., Automated Continuous Evolution of Proteins in Vivo. ACS Synth Biol. Jun. 19, 2020;9(6):1270-1276. doi: 10.1021/acssynbio.0c00135. Epub May 12, 2020. Author Manuscript, 14 pages.
Zhong et al., Seven novel variants expand the spectrum of RPE65-related Leber congenital amaurosis in the Chinese population. Mol Vis. Mar. 18, 2019;25:204-214.
Zhuang et al., Increasing the efficiency and precision of prime editing with guide RNA pairs. Nat Chem Biol. Jan. 2022;18(1):29-37. doi: 10.1038/s41589-021-00889-1. Epub Oct. 28, 2021.
[No Author Listed], CAR T cells to fight T cell leukemia. ISRCTN Registry. Nov. 11, 2022. doi: 10.1186/ISRCTN15323014. 9 pages.
[No Author Listed], *Homo sapiens* signal transducer and activator of transcription 3 (acute-phase response factor) (STAT3) gene, complete cds. GenBank Acc. No. AYS572796.1. Accessible at https://www.ncbi.nlm.nih.gov/nucleotide/AYS572796.1?report=genbank&log$=nuclalign&blast_rank=2&RID=BEG3KP4D014. Mar. 22, 2004. 36 pages.
[No Author Listed], Larimar Therapeutics Provides Update on CTI-1601 Clinical Program. Larimar Therapeutics, Inc. Feb. 14, 2022. Accessed Jun. 9, 2025 from <https://investors.larimartx.com/news-releases/news-release-details/larimar-therapeutics-provides-update-cti-1601-clinical-program>. 2 pages.
[No Author Listed], NCT03872479: Single Ascending Dose Study in Participants With LCA10. Sep. 26, 2019. 15 pages. Accessed Sep. 18, 2025 from <https://clinicaltrials.gov/study/NCT03872479>.
[No Author Listed], NCT04601051: Study to Evaluate Safety, Tolerability, Pharmacokinetics, and Pharmacodynamics of NTLA-2001 in Patients With Hereditary Transthyretin Amyloidosis With Polyneuropathy (ATTRv-PN) and Patients With Transthyretin Amyloidosis-Related Cardiomyopathy (ATTR-CM). Nov. 5, 2020. 19 pages. Accessed Sep. 18, 2025 from <https://clinicaltrials.gov/study/NCT04601051>.
[No Author Listed], RAD51 isoform 3. Uniprot Accession No. A0A2J8S626. Mar. 28, 2018. Accessible at https://www.uniprot.org/uniprotkb/A0A2J8S626/entry. 7 pages.
Adamson et al., Approaches to maximize sgRNA-barcode coupling in Perturb-seq screens. bioRxiv preprint. Apr. 11, 2018. doi: 10.1101/298349. 14 pages.
Albers et al., Engineered tRNAs suppress nonsense mutations in cells and in vivo. Nature. Jun. 2023;618(7966):842-848. doi: 10.1038/s41586-023-06133-1. Epub May 31, 2023.
Al-Mahdawi et al., Large Interruptions of GAA Repeat Expansion Mutations in Friedreich Ataxia Are Very Rare. Front Cell Neurosci. Nov. 21, 2018;12:443. doi: 10.3389/fncel.2018.00443.
Armbruster et al., Efficacy and biodistribution analysis of intracerebroventricular administration of an optimized scAAV9-SMN1 vector in a mouse model of spinal muscular atrophy. Mol Ther Methods Clin Dev. Sep. 14, 2016;3:16060. doi: 10.1038/mtm.2016.60.
Bandiera et al., Genetic variations creating microRNA target sites in the FXN 3'-UTR affect frataxin expression in Friedreich ataxia. PLoS One. 2013;8(1):e54791. doi: 10.1371/journal.pone.0054791. Epub Jan. 30, 2013.
Belbellaa et al., High Levels of Frataxin Overexpression Lead to Mitochondrial and Cardiac Toxicity in Mouse Models. Mol Ther Methods Clin Dev. Sep. 1, 2020;19:120-138. doi: 10.1016/j.omtm.2020.08.018.
Berg et al., Targeted sequencing reveals expanded genetic diversity of human transfer RNAs. RNA Biol. Nov. 2019;16(11):1574-1585. doi: 10.1080/15476286.2019.1646079. Epub Aug. 13, 2019.
Berg et al., Transfer RNAs: diversity in form and function. RNA Biol. Mar. 2021;18(3):316-339. doi: 10.1080/15476286.2020.1809197. Epub Sep. 9, 2020.
Berríos et al., Controllable genome editing with split-engineered base editors. Nat Chem Biol. Dec. 2021;17(12):1262-1270. doi: 10.1038/s41589-021-00880-w. Epub Oct. 18, 2021.
Bidichandani et al., Friedreich Ataxia. Dec. 18, 1998 [updated Apr. 10, 2025]. In: Adam MP, Feldman J, Mirzaa GM, Pagon RA, Wallace SE, Amemiya A, editors. GeneReviews® [Internet]. Seattle (WA): University of Washington, Seattle; 1993-2025. 41 pages.
Blum et al., Phage-assisted evolution of botulinum neurotoxin proteases with reprogrammed specificity. Science. Feb. 19, 2021;371(6531):803-810. doi: 10.1126/science.abf5972.
Brödel et al., Accelerated evolution of a minimal 63-amino acid dual transcription factor. Sci Adv. Jun. 10, 2020;6(24):eaba2728. doi: 10.1126/sciadv.aba2728.
Bryson et al., Continuous directed evolution of aminoacyl-tRNA synthetases. Nat Chem Biol. Dec. 2017;13(12):1253-1260. doi: 10.1038/nchembio.2474. Epub Oct. 16, 2017. Erratum in: Nat Chem Biol. Jan. 16, 2018;14(2):186. doi: 10.1038/nchembio0218-186.
Burgess et al., Possible dissociation of the heparin-binding and mitogenic activities of heparin-binding (acidic fibroblast) growth factor-1 from its receptor-binding activities by site-directed mutagenesis of a single lysine residue. J Cell Biol. Nov. 1990;111(5 Pt 1):2129-38. doi: 10.1083/jcb.111.5.2129.
Buvoli et al., Suppression of nonsense mutations in cell culture and mice by multimerized suppressor tRNA genes. Mol Cell Biol. May 2000;20(9):3116-24. doi: 10.1128/MCB.20.9.3116-3124.2000.
Canver et al., BCL11A enhancer dissection by Cas9-mediated in situ saturating mutagenesis. Nature. Nov. 12, 2015;527(7577):192-7. doi: 10.1038/nature15521. Epub Sep. 16, 2015.

(56) References Cited

OTHER PUBLICATIONS

Čavužić et al., Biosynthesis of Sulfur-Containing tRNA Modifications: A Comparison of Bacterial, Archaeal, and Eukaryotic Pathways. Biomolecules. Mar. 11, 2017;7(1):27. doi: 10.3390/biom7010027.

Chan et al., GtRNAdb 2.0: an expanded database of transfer RNA genes identified in complete and draft genomes. Nucleic Acids Res. Jan. 4, 2016;44(D1):D184-9. doi: 10.1093/nar/gkv1309. Epub Dec. 15, 2015.

Chandran et al., Inducible and reversible phenotypes in a novel mouse model of Friedreich's Ataxia. Elife. Dec. 19, 2017;6:e30054. doi: 10.7554/eLife.30054.

Chelico et al., APOBEC3G DNA deaminase acts processively 3' -- > 5' on single-stranded DNA. Nat Struct Mol Biol. May 2006;13(5):392-9. doi: 10.1038/nsmb1086. Epub Apr. 23, 2006.

Chen et al., Re-engineering the adenine deaminase TadA-8e for efficient and specific CRISPR-based cytosine base editing. Nat Biotechnol. May 2023;41(5):663-672. doi: 10.1038/s41587-022-01532-7. Epub Nov. 10, 2022. Erratum in: Nat Biotechnol. Jun. 2024;42(6):987. doi: 10.1038/s41587-024-02252-w.

Chen et al., Targeted activation of diverse CRISPR-Cas systems for mammalian genome editing via proximal CRISPR targeting. Nat Commun. Apr. 7, 2017;8:14958. doi: 10.1038/ncomms14958.

Cheng et al., Essential role of mitochondrial Stat3 in p38MAPK mediated apoptosis under oxidative stress. Sci Rep. Nov. 13, 2017;7(1):15388. doi: 10.1038/s41598-017-15342-4. Erratum in: Sci Rep. Apr. 12, 2018;8(1):6119. doi: 10.1038/s41598-018-23431-1.

Chester et al., Optimization of apolipoprotein B mRNA editing by APOBEC1 apoenzyme and the role of its auxiliary factor, ACF. RNA. Sep. 2004;10(9):1399-411. doi: 10.1261/rna.7490704. Epub Jul. 23, 2004.

Cho et al., Targeted A-to-G base editing in human mitochondrial DNA with programmable deaminases. Cell. May 12, 2022;185(10):1764-1776.e12. doi: 10.1016/j.cell.2022.03.039. Epub Apr. 25, 2022.

Chu et al., Rationally Designed Base Editors for Precise Editing of the Sickle Cell Disease Mutation. CRISPR J. Apr. 2021;4(2):169-177. doi: 10.1089/crispr.2020.0144.

Cinesi et al., Contracting CAG/CTG repeats using the CRISPR-Cas9 nickase. Nat Commun. Nov. 9, 2016;7:13272. doi: 10.1038/ncomms13272. Erratum in: Nat Commun. Oct. 17, 2024;15(1):8951. doi: 10.1038/s41467-024-52719-2.

Clark et al., Expansion of GAA triplet repeats in the human genome: unique origin of the FRDA mutation at the center of an Alu. Genomics. Mar. 2004;83(3):373-83. doi: 10.1016/j.ygeno.2003.09.001.

Clarke et al., The effect of premature termination codon mutations on CFTR mRNA abundance in human nasal epithelium and intestinal organoids: a basis for read-through therapies in cystic fibrosis. Hum Mutat. Mar. 2019;40(3):326-334. doi: 10.1002/humu.23692. Epub Dec. 10, 2018.

Cnop et al., Diabetes in Friedreich ataxia. J Neurochem. Aug. 2013;126 Suppl 1:94-102. doi: 10.1111/jnc.12216.

Cofsky et al., CRISPR-Cas9 bends and twists DNA to read its sequence. Nat Struct Mol Biol. Apr. 2022;29(4):395-402. doi: 10.1038/s41594-022-00756-0. Epub Apr. 14, 2022.

Cook et al., Friedreich's ataxia: clinical features, pathogenesis and management. Br Med Bull. Dec. 1, 2017;124(1):19-30. doi: 10.1093/bmb/ldx034.

Cuella-Martin et al., Functional interrogation of DNA damage response variants with base editing screens. Cell. Feb. 18, 2021;184(4):1081-1097.e19. doi: 10.1016/j.cell.2021.01.041.

Dabrowska et al., Precise Excision of the CAG Tract from the Huntingtin Gene by Cas9 Nickases. Front Neurosci. Feb. 26, 2018;12:75. doi: 10.3389/fnins.2018.00075.

De Biase et al., Progressive GAA expansions in dorsal root ganglia of Friedreich's ataxia patients. Ann Neurol. Jan. 2007;61(1):55-60. doi: 10.1002/ana.21052.

Delatycki et al., Friedreich ataxia-pathogenesis and implications for therapies. Neurobiol Dis. Dec. 2019;132:104606. doi: 10.1016/j.nbd.2019.104606. Epub Sep. 5, 2019.

Durrant et al., Systematic discovery of recombinases for efficient integration of large DNA sequences into the human genome. Nat Biotechnol. Apr. 2023;41(4):488-499. doi: 10.1038/s41587-022-01494-w. Epub Oct. 10, 2022.

Duvoisin et al., Human U6 promoter drives stronger shRNA activity than its schistosome orthologue in Schistosoma mansoni and human fibrosarcoma cells. Transgenic Res. Jun. 2012;21(3):511-21. doi: 10.1007/s11248-011-9548-0. Epub Sep. 28, 2011.

Eisenstein et al., Base editing marches on the clinic. Nat Biotechnol. May 2022;40(5):623-625. doi: 10.1038/s41587-022-01326-x.

Enache et al., Cas9 activates the p53 pathway and selects for p53-inactivating mutations. Nat Genet. Jul. 2020;52(7):662-668. doi: 10.1038/s41588-020-0623-4. Epub May 18, 2020. Erratum in: Nat Genet. Jul. 2020;52(7):748-749. doi: 10.1038/s41588-020-0663-9.

Esashi et al., Stabilization of RAD51 nucleoprotein filaments by the C-terminal region of BRCA2. Nat Struct Mol Biol. Jun. 2007;14(6):468-74. doi: 10.1038/nsmb1245. Epub May 21, 2007.

Finkel et al., One-Time Intrathecal (IT) Administration of AVXS-101 IT Gene-Replacement Therapy for Spinal Muscular Atrophy: Phase 1 Study. Neurology. Apr. 14, 2020;94(15_Suppl). doi: 10.1212/WNL.94.15_supplement.249.

Fisher et al., Transduction with recombinant adeno-associated virus for gene therapy is limited by leading-strand synthesis. J Virol. Jan. 1996;70(1):520-32. doi: 10.1128/JVI.70.1.520-532.1996.

Fishman-Lobell et al., Two alternative pathways of double-strand break repair that are kinetically separable and independently modulated. Mol Cell Biol. Mar. 1992;12(3):1292-303. doi: 10.1128/mcb.12.3.1292-1303.1992.

Frangoul et al., CRISPR-Cas9 Gene Editing for Sickle Cell Disease and β-Thalassemia. N Engl J Med. Jan. 21, 2021;384(3):252-260. doi: 10.1056/NEJMoa2031054. Epub Dec. 5, 2020.

Fry et al., RNA editing as a therapeutic approach for retinal gene therapy requiring long coding sequences. Int J Mol Sci. Jan. 25, 2020;21(3):777. doi: 10.3390/ijms21030777.

Garcia et al., Identification of the rate-determining step of tRNA-guanine transglycosylase from *Escherichia coli*. Biochemistry. Dec. 1, 2009;48(47):11243-51. doi: 10.1021/bi901501a.

Giegé et al., Universal rules and idiosyncratic features in tRNA identity. Nucleic Acids Res. Nov. 15, 1998;26(22):5017-35. doi: 10.1093/nar/26.22.5017.

Goldstein et al., The tangled bank of amino acids. Protein Sci. Jul. 2016;25(7):1354-62. doi: 10.1002/pro.2930. Epub May 12, 2016.

Greene et al., Repeat-induced epigenetic changes in intron 1 of the frataxin gene and its consequences in Friedreich ataxia. Nucleic Acids Res. 2007;35(10):3383-90. doi: 10.1093/nar/gkm271. Epub May 3, 2007.

Grimm et al., Helper virus-free, optically controllable, and two-plasmid-based production of adeno-associated virus vectors of serotypes 1 to 6. Mol Ther. Jun. 2003;7(6):839-50. doi: 10.1016/s1525-0016(03)00095-9.

Grimm et al., Novel tools for production and purification of recombinant adenoassociated virus vectors. Hum Gene Ther. Dec. 10, 1998;9(18):2745-60. doi: 10.1089/hum.1998.9.18-2745.

Grünewald et al., A dual-deaminase CRISPR base editor enables concurrent adenine and cytosine editing. Nat Biotechnol. Jul. 2020;38(7):861-864. doi: 10.1038/s41587-020-0535-y. Epub Jun. 1, 2020.

Grünewald et al., CRISPR DNA base editors with reduced RNA off-target and self-editing activities. Nat Biotechnol. Sep. 2019;37(9):1041-1048. doi: 10.1038/s41587-019-0236-6. Epub Sep. 2, 2019.

Han et al., C2H2 Zinc Finger Proteins: Master Regulators of Abiotic Stress Responses in Plants. Front Plant Sci. Feb. 20, 2020;11:115. doi: 10.3389/fpls.2020.00115. Erratum in: Front Plant Sci. Mar. 18, 2020;11:298. doi: 10.3389/fpls.2020.00298.

Himeno et al., Only one nucleotide insertion to the long variable arm confers an efficient serine acceptor activity upon Saccharomyces cerevisiae tRNA(Leu) in vitro. J Mol Biol. May 16, 1997;268(4):704-11. doi: 10.1006/jmbi.1997.0991.

(56) References Cited

OTHER PUBLICATIONS

Hong et al., Mechanism of tRNA-mediated +1 ribosomal frameshifting. Proc Natl Acad Sci U S A. Oct. 30, 2018;115(44):11226-11231. doi: 10.1073/pnas.1809319115. Epub Sep. 27, 2018.
Hu et al., A compact Cas9 ortholog from *Staphylococcus auricularis* (SauriCas9) expands the DNA targeting scope. PLoS Biol. Mar. 30, 2020;18(3):e3000686. doi: 10.1371/journal.pbio.3000686.
Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015.
Huichalaf et al., In vivo overexpression of frataxin causes toxicity mediated by iron-sulfur cluster deficiency. Mol Ther Methods Clin Dev. Feb. 7, 2022;24:367-378. doi: 10.1016/j.omtm.2022.02.002.
Iascone et al., Spinal muscular atrophy: from tissue specificity to therapeutic strategies. F1000Prime Rep. Jan. 5, 2015;7:04. doi: 10.12703/P7-04.
Iben et al., tRNA gene copy number variation in humans. Gene. Feb. 25, 2014;536(2):376-84. doi: 10.1016/j.gene.2013.11.049. Epub Dec. 14, 2013.
Isgrig et al., Gene Therapy Restores Balance and Auditory Functions in a Mouse Model of Usher Syndrome. Mol Ther. Mar. 1, 2017;25(3):780-791. doi: 10.1016/j.ymthe.2017.01.007. Epub Feb. 21, 2017. Erratum in: Mol Ther. Feb. 2, 2022;30(2):975. doi: 10.1016/j.ymthe.2022.01.026.
Jeong et al., Adenine base editor engineering reduces editing of bystander cytosines. Nat Biotechnol. Nov. 2021;39(11):1426-1433. doi: 10.1038/s41587-021-00943-2. Epub Jul. 1, 2021.
Jeong et al., Construction of non-canonical PAM-targeting adenosine base editors by restriction enzyme-free DNA cloning using CRISPR-Cas9. Sci Rep. Mar. 20, 2019;9(1):4939. doi: 10.1038/s41598-019-41356-1.
Jiralerspong et al., Frataxin shows developmentally regulated tissue-specific expression in the mouse embryo. Neurobiol Dis. 1997;4(2):103-13. doi: 10.1006/nbdi.1997.0139.
Jo et al., CRISPR-Cas9-mediated therapeutic editing of Rpe65 ameliorates the disease phenotypes in a mouse model of Leber congenital amaurosis. Sci Adv. Oct. 30, 2019;5(10):eaax1210. doi: 10.1126/sciadv.aax1210.
Johnston et al., Continuous bioactivity-dependent evolution of an antibiotic biosynthetic pathway. Nat Commun. Aug. 21, 2020;11(1):4202. doi: 10.1038/s41467-020-18018-2.
Jones et al., Phage-Assisted Continuous Evolution and Selection of Enzymes for Chemical Synthesis. ACS Cent Sci. Sep. 22, 2021;7(9):1581-1590. doi: 10.1021/acscentsci.1c00811. Epub Sep. 13, 2021.
Jumper et al., Highly accurate protein structure prediction with AlphaFold. Nature. Aug. 2021;596(7873):583-589. doi: 10.1038/s41586-021-03819-2. Epub Jul. 15, 2021.
Kacher et al., Propensity for somatic expansion increases over the course of life in Huntington disease. Elife. May 13, 2021;10:e64674. doi: 10.7554/eLife.64674.
Karijolich et al., Therapeutic suppression of premature termination codons: mechanisms and clinical considerations (review). Int J Mol Med. Aug. 2014;34(2):355-62. doi: 10.3892/ijmm.2014.1809. Epub Jun. 17, 2014.
Kawakami, K., Tol2: a versatile gene transfer vector in vertebrates. Genome Biol. 2007;8 Suppl 1(Suppl 1):S7. doi: 10.1186/GB-2007-8-s1-s7.
Kern et al., Identification of a heparin-binding motif on adeno-associated virus type 2 capsids. J Virol. Oct. 2003;77(20):11072-81. doi: 10.1128/jvi.77.20.11072-11081.2003.
Khristich et al., Large-scale contractions of Friedreich's ataxia GAA repeats in yeast occur during DNA replication due to their triplex-forming ability. Proc Natl Acad Sci U S A. Jan. 21, 2020;117(3):1628-1637. doi: 10.1073/pnas.1913416117. Epub Jan. 7, 2020.
Krishnamurthy et al., Functional correction of CFTR mutations in human airway epithelial cells using adenine base editors. Nucleic Acids Res. Oct. 11, 2021;49(18):10558-10572. doi: 10.1093/nar/gkab788.
Kronenberg et al., A conformational change in the adeno-associated virus type 2 capsid leads to the exposure of hidden VP1 N termini. J Virol. May 2005;79(9):5296-303. doi: 10.1128/JVI.79.9.5296-5303.2005.
Kuzmin et al., The clinical landscape for AAV gene therapies. Nat Rev Drug Discov. Mar. 2021;20(3):173-174. doi: 10.1038/d41573-021-00017-7.
Lam et al., Improved cytosine base editors generated from TadA variants. Nat Biotechnol. May 2023;41(5):686-697. doi: 10.1038/s41587-022-01611-9. Epub Jan. 9, 2023.
Lant et al., Pathways to disease from natural variations in human cytoplasmic tRNAs. J Biol Chem. Apr. 5, 2019;294(14):5294-5308. doi: 10.1074/jbc.REV118.002982. Epub Jan. 14, 2019.
Lazaropoulos et al., Frataxin levels in peripheral tissue in Friedreich ataxia. Ann Clin Transl Neurol. Aug. 2015;2(8):831-42. doi: 10.1002/acn3.225. Epub Jul. 1, 2015.
Li et al., Excision of Expanded GAA Repeats Alleviates the Molecular Phenotype of Friedreich's Ataxia. Mol Ther. Jun. 2015;23(6):1055-1065. doi: 10.1038/mt.2015.41. Epub Mar. 11, 2015.
Li et al., Excision of the expanded GAA repeats corrects cardiomyopathy phenotypes of iPSC- derived Friedreich's ataxia cardiomyocytes. Stem Cell Res. Oct. 2019;40:101529. doi: 10.1016/j.scr.2019.101529. Epub Aug. 7, 2019.
Li et al., Premature transcription termination at the expanded GAA repeats and aberrant alternative polyadenylation contributes to the Frataxin transcriptional deficit in Friedreich's ataxia. Hum Mol Genet. Oct. 10, 2022;31(20):3539-3557. doi: 10.1093/hmg/ddac134.
Li et al., Targeted, random mutagenesis of plant genes with dual cytosine and adenine base editors. Nat Biotechnol. Jul. 2020;38(7):875-882. doi: 10.1038/s41587-019-0393-7. Epub Jan. 13, 2020.
Liang et al., AGBE: a dual deaminase-mediated base editor by fusing CGBE with ABE for creating a saturated mutant population with multiple editing patterns. Nucleic Acids Res. May 20, 2022;50(9):5384-5399. doi: 10.1093/nar/gkac353.
Lin et al., Structure-function relationships in glucagon: properties of highly purified des-His-1-, monoiodo-, and (des-Asn-28, Thr-29)(homoserine lactone-27)-glucagon. Biochemistry. Apr. 22, 1975;14(8):1559-63. doi: 10.1021/bi00679a002.
Liu et al., DNA base excision repair: a mechanism of trinucleotide repeat expansion. Trends Biochem Sci. Apr. 2012;37(4):162-72. doi: 10.1016/j.tibs.2011.12.002. Epub Jan. 27, 2012.
Long et al., Somatic instability of the expanded GAA repeats in Friedreich's ataxia. PLoS One. Dec. 19, 2017;12(12):e0189990. doi: 10.1371/journal.pone.0189990.
Lue et al., Base editor scanning charts the DNMT3A activity landscape. Nat Chem Biol. Feb. 2023;19(2):176-186. doi: 10.1038/s41589-022-01167-4. Epub Oct. 20, 2022.
Ma et al., A new mutation in BFSP2 (G1091A) causes autosomal dominant congenital lamellar cataracts. Mol Vis. 2008;14:1906-11. Epub Oct. 24, 2008.
Ma et al., Highly efficient and precise base editing by engineered dCas9-guide tRNA adenosine deaminase in rats. Cell Discov. Jul. 17, 2018;4:39. doi: 10.1038/s41421-018-0047-9.
Massey et al., The central role of DNA damage and repair in CAG repeat diseases. Dis Model Mech. Jan. 30, 2018;11(1):dmm031930. doi: 10.1242/dmm.031930.
Mauriac et al., A hop, skip, and a jump to evade USH2A deaf-blindness mutations. Mol Ther. Aug. 4, 2021;29(8):2391-2393. doi: 10.1016/j.ymthe.2021.07.008. Epub Jul. 23, 2021.
Mazzara et al., Frataxin gene editing rescues Friedreich's ataxia pathology in dorsal root ganglia organoid-derived sensory neurons. Nat Commun. Aug. 21, 2020;11(1):4178. doi: 10.1038/s41467-020-17954-3.
Métais et al., Genome editing of HBG1 and HBG2 to induce fetal hemoglobin. Blood Adv. Nov. 12, 2019;3(21):3379-3392. doi: 10.1182/bloodadvances.2019000820.
Meyer et al., Improving single injection CSF delivery of AAV9-mediated gene therapy for SMA: a dose-response study in mice and nonhuman primates. Mol Ther. Mar. 2015;23(3):477-87. doi: 10.1038/mt.2014.210. Epub Oct. 31, 2014.

(56) References Cited

OTHER PUBLICATIONS

Miller et al., Cell-surface receptors for retroviruses and implications for gene transfer. Proc Natl Acad Sci U S A. Oct. 15, 1996;93(21):11407-13. doi: 10.1073/pnas.93.21.11407.
Mohr et al., Dominant-negative activity of the STAT3-Y705F mutant depends on the N-terminal domain. Cell Commun Signal. Nov. 5, 2013;11:83. doi: 10.1186/1478-811X-11-83.
Mok et al., CRISPR-free base editors with enhanced activity and expanded targeting scope in mitochondrial and nuclear DNA. Nat Biotechnol. Sep. 2022;40(9):1378-1387. doi: 10.1038/s41587-022-01256-8. Epub Apr. 4, 2022.
Monteys et al., CRISPR/Cas9 Editing of the Mutant Huntingtin Allele In Vitro and In Vivo. Mol Ther. Jan. 4, 2017;25(1):12-23. doi: 10.1016/j.ymthe.2016.11.010. Epub Jan. 4, 2017.
Mort et al., A meta-analysis of nonsense mutations causing human genetic disease. Hum Mutat. Aug. 2008;29(8):1037-47. doi: 10.1002/humu.20763.
Moullier et al., International efforts for recombinant adeno-associated viral vector reference standards. Mol Ther. Jul. 2008;16(7):1185-8. doi: 10.1038/mt.2008.125.
Neil et al., Replication-independent instability of Friedreich's ataxia GAA repeats during chronological aging. Proc Natl Acad Sci U S A. Feb. 2, 2021;118(5):e2013080118. doi: 10.1073/pnas.2013080118.
Nethisinghe et al., Interruptions of the FXN GAA Repeat Tract Delay the Age at Onset of Friedreich's Ataxia in a Location Dependent Manner. Int J Mol Sci. Jul. 13, 2021;22(14):7507. doi: 10.3390/ijms22147507.
Nonekowski et al., The *Escherichia coli* tRNA-guanine transglycosylase can recognize and modify DNA. J Biol Chem. Mar. 1, 2002;277(9):7178-82. doi: 10.1074/jbc.M111077200. Epub Dec. 21, 2001.
Nunez et al., Chemical and Biophysical Modulation of Cas9 for Tunable Genome Engineering. ACS Chem Biol. Mar. 18, 2016;11(3):681-8. doi: 10.1021/acschembio.5b01019. Epub Feb. 9, 2016.
Ohshima et al., A nonpathogenic GAAGGA repeat in the Friedreich gene: implications for pathogenesis. Neurology. Nov. 10, 1999;53(8):1854-7. doi: 10.1212/wnl.53.8.1854.
Oura et al., Precise CAG repeat contraction in a Huntington's Disease mouse model is enabled by gene editing with SpCas9-NG. Commun Biol. Jun. 23, 2021;4(1):771. doi: 10.1038/s42003-021-02304-w.
Pandolfo, M., Friedreich ataxia: new pathways. J Child Neurol. Sep. 2012;27(9):1204-11. doi: 10.1177/0883073812448534. Epub Jun. 29, 2012.
Park et al., Off-Target Editing by CRISPR-Guided DNA Base Editors. Biochemistry. Sep. 10, 2019;58(36):3727-3734. doi: 10.1021/acs.biochem.9b00573. Epub Aug. 26, 2019.
Perkel, J.M., CRISPR Is Still on Point When It Comes to Genome Editing. Biocompare. Jun. 2, 2016. Accessed from < https://www.biocompare.com/Editorial-Articles/187183-CRISPR-Is-Still-on-Point-When-It-Comes-to-Genome-Editing/>. 8 pages.
Pettersen et al., UCSF Chimera—a visualization system for exploratory research and analysis. J Comput Chem. Oct. 2004;25(13):1605-12. doi: 10.1002/jcc.20084.
Piccioni et al., Pooled Lentiviral-Delivery Genetic Screens. Curr Protoc Mol Biol. Jan. 16, 2018;121:32.1.1-32.1.21. doi: 10.1002/cpmb.52.
Pickar-Oliver et al., The next generation of CRISPR-Cas technologies and applications. Nat Rev Mol Cell Biol. Aug. 2019;20(8):490-507. doi: 10.1038/s41580-019-0131-5.
Pinto et al., Patterns of CAG repeat instability in the central nervous system and periphery in Huntington's disease and in spinocerebellar ataxia type 1. Hum Mol Genet. Aug. 29, 2020;29(15):2551-2567. doi: 10.1093/hmg/ddaa139.
Ponting, C.P., Biological function in the twilight zone of sequence conservation. BMC Biol. Aug. 16, 2017;15(1):71. doi: 10.1186/s12915-017-0411-5.
Preece et al., 'Mini' U6 Pol III promoter exhibits nucleosome redundancy and supports multiplexed coupling of CRISPR/Cas9 effects. Gene Ther. Sep. 2020;27(9):451-458. doi: 10.1038/s41434-020-0142-z. Epub Mar. 20, 2020.
Punga et al., Long intronic GAA repeats causing Friedreich ataxia impede transcription elongation. EMBO Mol Med. Apr. 2010;2(4):120-9. doi: 10.1002/emmm.201000064.
Puspasari et al., Long range regulation of human FXN gene expression. PLoS One. 2011;6(7):e22001. doi: 10.1371/journal.pone.0022001. Epub Jul. 8, 2011.
Qiao et al., AID Recognizes Structured DNA for Class Switch Recombination. Mol Cell. Aug. 3, 2017;67(3):361-373.e4. doi: 10.1016/j.molcel.2017.06.034. Epub Jul. 27, 2017.
Reeck et al., "Homology" in proteins and nucleic acids: a terminology muddle and a way out of it. Cell. Aug. 28, 1987;50(5):667. doi: 10.1016/0092-8674(87)90322-9.
Reetz et al., Biological and clinical characteristics of the European Friedreich's Ataxia Consortium for Translational Studies (EFACTS) cohort: a cross-sectional analysis of baseline data. Lancet Neurol. Feb. 2015;14(2):174-82. doi: 10.1016/S1474-4422(14)70321-7. Epub Jan. 5, 2015.
Rocca et al., CRISPR-Cas9 Gene Editing of Hematopoietic Stem Cells from Patients with Friedreich's Ataxia. Mol Ther Methods Clin Dev. May 3, 2020;17:1026-1036. doi: 10.1016/j.omtm.2020.04.018.
Rolfsmeier et al., Stabilizing effects of interruptions on trinucleotide repeat expansions in *Saccharomyces cerevisiae*. Mol Cell Biol. Jan. 2000;20(1):173-80. doi: 10.1128/MCB.20.1.173-180.2000.
Roth et al., Phage-Assisted Evolution of Bacillus methanolicus Methanol Dehydrogenase 2. ACS Synth Biol. Apr. 19, 2019;8(4):796-806. doi: 10.1021/acssynbio.8b00481. Epub Mar. 20, 2019.
Roth, J.R., Frameshift suppression. Cell. Jun. 1981;24(3):601-2. doi: 10.1016/0092-8674(81)90086-6.
Rudin et al., Efficient repair of HO-induced chromosomal breaks in *Saccharomyces cerevisiae* by recombination between flanking homologous sequences. Mol Cell Biol. Sep. 1988;8(9):3918-28. doi: 10.1128/mcb.8.9.3918-3928.1988.
Sakamoto et al., GGA*TCC-interrupted triplets in long GAA*TTC repeats inhibit the formation of triplex and sticky DNA structures, alleviate transcription inhibition, and reduce genetic instabilities. J Biol Chem. Jul. 20, 2001;276(29):27178-87. doi: 10.1074/jbc.M101852200. Epub Apr. 26, 2001.
Sakata et al., Base editors for simultaneous introduction of C-to-T and A-to-G mutations. Nat Biotechnol. Jul. 2020;38(7):865-869. doi: 10.1038/s41587-020-0509-0. Epub Jun. 2, 2020. Erratum in: Nat Biotechnol. Jul. 2020;38(7):901. doi: 10.1038/s41587-020-0585-1.
Santos et al., Friedreich ataxia: molecular mechanisms, redox considerations, and therapeutic opportunities. Antioxid Redox Signal. Sep. 1, 2010;13(5):651-90. doi: 10.1089/ars.2009.3015.
Schmelas et al., Split Cas9, Not Hairs—Advancing the Therapeutic Index of CRISPR Technology. Biotechnol J. Sep. 2018;13(9):e1700432. doi: 10.1002/biot.201700432. Epub Feb. 2, 2018.
Schwartz et al., A superactive insulin: [B10-aspartic acid]insulin(human). Proc Natl Acad Sci U S A. Sep. 1987;84(18):6408-11. doi: 10.1073/pnas.84.18.6408.
Shin et al., Permanent inactivation of Huntington's disease mutation by personalized allele-specific CRISPR/Cas9. Hum Mol Genet. Oct. 15, 2016;25(20):4566-4576. doi: 10.1093/hmg/ddw286.
Shishkin et al., Large-scale expansions of Friedreich's ataxia GAA repeats in yeast. Mol Cell. Jul. 10, 2009;35(1):82-92. doi: 10.1016/j.molcel.2009.06.017.
Silva et al., Expanded GAA repeats impair FXN gene expression and reposition the FXN locus to the nuclear lamina in single cells. Hum Mol Genet. Jun. 15, 2015;24(12):3457-71. doi: 10.1093/hmg/ddv096. Epub Mar. 26, 2015.
Soragni et al., Long intronic GAA*TTC repeats induce epigenetic changes and reporter gene silencing in a molecular model of Friedreich ataxia. Nucleic Acids Res. Nov. 2008;36(19):6056-65. doi: 10.1093/nar/gkn604. Epub Sep. 27, 2008.
Spencer et al., Deep mutational scanning of *S. pyogenes* Cas9 reveals important functional domains. Sci Rep. Dec. 4, 2017;7(1):16836. doi: 10.1038/s41598-017-17081-y.

(56) References Cited

OTHER PUBLICATIONS

Strauss et al., Onasemnogene abeparvovec for presymptomatic infants with two copies of SMN2 at risk for spinal muscular atrophy type 1: the Phase III SPRINT trial. Nat Med. Jul. 2022;28(7):1381-1389. doi: 10.1038/s41591-022-01866-4. Epub Jun. 17, 2022.
Su et al., Role of the RAD51-SWI5-SFR1 Ensemble in homologous recombination. Nucleic Acids Res. Jul. 27, 2016;44(13):6242-51. doi: 10.1093/nar/gkw375. Epub Apr. 30, 2016.
Swami et al., Somatic expansion of the Huntington's disease CAG repeat in the brain is associated with an earlier age of disease onset. Hum Mol Genet. Aug. 15, 2009;18(16):3039-47. doi: 10.1093/hmg/ddp242. Epub May 23, 2009.
Tabebordbar et al., Directed evolution of a family of AAV capsid variants enabling potent muscle-directed gene delivery across species. Cell. Sep. 16, 2021;184(19):4919-4938.e22. doi: 10.1016/j.cell.2021.08.028. Epub Sep. 9, 2021.
Takahashi et al., Induction of pluripotent stem cells from mouse embryonic and adult fibroblast cultures by defined factors. Cell. Aug. 25, 2006;126(4):663-76. doi: 10.1016/j.cell.2006.07.024. Epub Aug. 10, 2006.
Tao et al., Bi-PE: bi-directional priming improves CRISPR/Cas9 prime editing in mammalian cells. Nucleic Acids Res. Jun. 24, 2022;50(11):6423-6434. doi: 10.1093/nar/gkac506.
Torres et al., Differential expression of human tRNA genes drives the abundance of tRNA- derived fragments. Proc Natl Acad Sci U S A. Apr. 23, 2019;116(17):8451-8456. doi: 10.1073/pnas.1821120116. Epub Apr. 8, 2019.
Tou et al., Precise cut-and-paste DNA insertion using engineered type V-K CRISPR-associated transposases. Nat Biotechnol. Jul. 2023;41(7):968-979. doi: 10.1038/s41587-022-01574-x. Epub Jan. 2, 2023.
Tou et al., Recent Advances in Double-Strand Break-Free Kilobase-Scale Genome Editing Technologies. Biochemistry. Dec. 19, 2023;62(24):3493-3499. doi: 10.1021/acs.biochem.2c00311. Epub Sep. 1, 2022.
Van Alstyne et al., Gain of toxic function by long-term AAV9-mediated SMN overexpression in the sensorimotor circuit. Nat Neurosci. Jul. 2021;24(7):930-940. doi: 10.1038/s41593-021-00827-3. Epub Apr. 1, 2021.
Wang et al., AAV-delivered suppressor tRNA overcomes a nonsense mutation in mice. Nature. Apr. 2022;604(7905):343-348. doi: 10.1038/s41586-022-04533-3. Epub Mar. 23, 2022.
Wang et al., Efficient base editing in methylated regions with a human APOBEC3A-Cas9 fusion. Nat Biotechnol. Nov. 2018;36(10):946-949. doi: 10.1038/nbt.4198. Epub Aug. 20, 2018.
Wilkinson et al., Cas9-AAV6 gene correction of beta-globin in autologous HSCs improves sickle cell disease erythropoiesis in mice. Nat Commun. Jan. 29, 2021;12(1):686. doi: 10.1038/s41467-021-20909-x.
Wu et al., Highly efficient therapeutic gene editing of human hematopoietic stem cells. Nat Med. May 2019;25(5):776-783. doi: 10.1038/s41591-019-0401-y. Epub Mar. 25, 2019.
Xie et al., ACBE, a new base editor for simultaneous C-to-T and A-to-G substitutions in mammalian systems. BMC Biol. Sep. 23, 2020;18(1):131. doi: 10.1186/s12915-020-00866-5.
Xu et al., High-throughput mapping of a whole rhesus monkey brain at micrometer resolution. Nat Biotechnol. Dec. 2021;39(12):1521-1528. doi: 10.1038/s41587-021-00986-5. Epub Jul. 26, 2021.
Yamaguchi et al., Isolation and purification of blasticidin S deaminase from Aspergillus terreus. J Antibiotics. Jan. 1, 1975;28(1):7-14.
Yamaguchi et al., Substrate Binding by Blasticidin S Deaminase, an Aminohydrolase for Novel 4-Aminopyrimidine Nucleosides. Pesticide Biochem Physiol. Feb. 1986;25(1):54-62.
Yamazaki et al., Intein Mediated Ligation of Protein Fragments—Application to Segmental Isotope Labeling of NMR Samples. Biophysics. May 25, 1999:39(3):182-184.
Yang et al., CRISPR/Cas9-mediated gene editing ameliorates neurotoxicity in mouse model of Huntington's disease. J Clin Invest. Jun. 30, 2017;127(7):2719-2724. doi: 10.1172/JCI92087. Epub Jun. 19, 2017.
Yang et al., Time-dependent maturation of cationic liposome-DNA complex for serum resistance. Gene Ther. Mar. 1998;5(3):380-7. doi: 10.1038/sj.gt.3300596.
Yarnall et al., Drag-and-drop genome insertion of large sequences without double-strand DNA cleavage using CRISPR-directed integrases. Nat Biotechnol. Apr. 2023;41(4):500-512. doi: 10.1038/s41587-022-01527-4. Epub Nov. 24, 2022.
Zhang et al., A humanized knockin mouse model of Duchenne muscular dystrophy and its correction by CRISPR-Cas9 therapeutic gene editing. Mol Ther Nucleic Acids. Aug. 1, 2022;29:525-537. doi: 10.1016/j.omtn.2022.07.024.
Zhang et al., Development and application of CRISPR/Cas9 technologies in genomic editing. Hum Mol Genet. Aug. 1, 2018;27(R2):R79-R88. doi: 10.1093/hmg/ddy120.
Zhang et al., Dual base editor catalyzes both cytosine and adenine base conversions in human cells. Nat Biotechnol. Jul. 2020;38(7):856-860. doi: 10.1038/s41587-020-0527-y. Epub Jun. 1, 2020.
Zhang et al., TadA orthologs enable both cytosine and adenine editing of base editors. Nat Commun. Jan. 26, 2023;14(1):414. doi: 10.1038/s41467-023-36003-3.
Zhu et al., Guide RNAs with embedded barcodes boost CRISPR-pooled screens. Genome Biol. Jan. 24, 2019;20(1):20. doi: 10.1186/s13059-019-1628-0.

* cited by examiner

| | ssDNA cytidine deaminase base editor | dsDNA cytidine deaminase base editor |
|---|---|---|
| **Editing Specificity** | Higher specificity; Cytidines in R-loop are preferentially deaminated | Lower specificity; Any TC's dsDNA may be deaminated |
| **Polarity of DNA strand for editing** | Only cytidines in R loop are edited | Cytidines on one or both DNA strands may be deaminated |
| **Uracil repair** | Repair of uracils on single DNA strand generates a nick | Repair of uracils on opposite DNA strands generates a DSB |

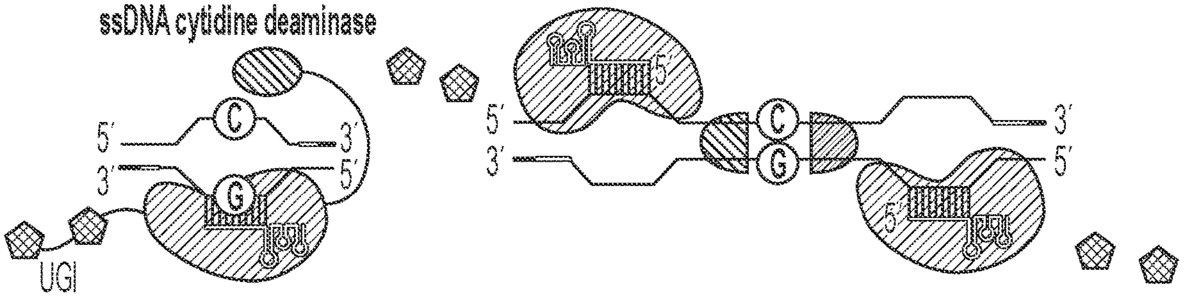

FIG. 2B

| | |
|---|---|
| T62 | I110 |
| D71 | G122 |
| G73 | I135 |
| G84 | N138 |
| A94 | G148 |
| N108 | G155 |
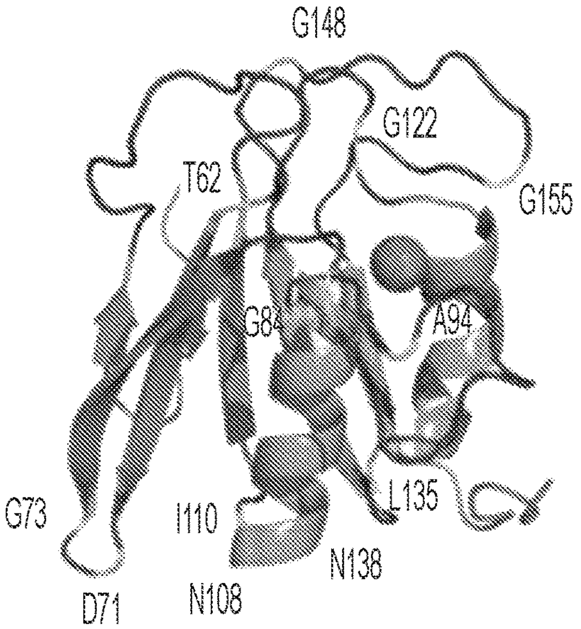
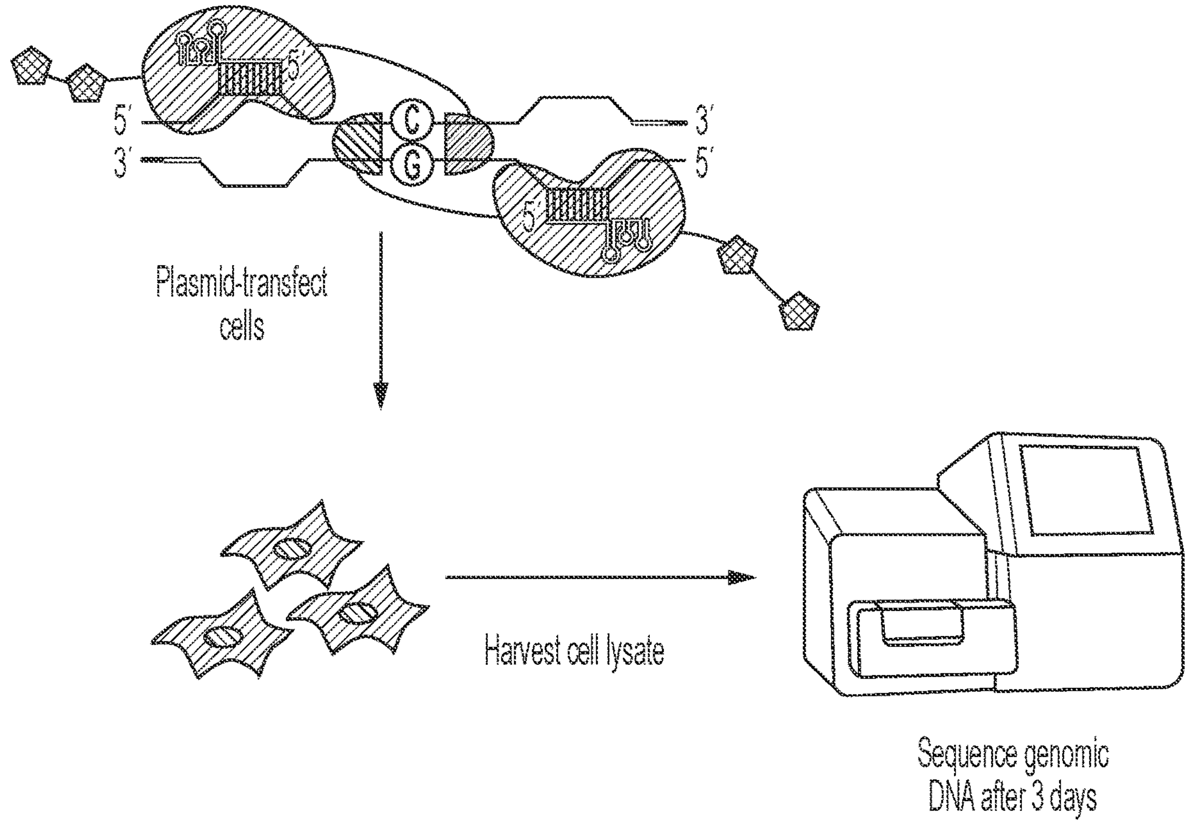
FIG. 3

| Plasmid | Architecture | Expected Mw (kDa) |
|---|---|---|
| TC 31 | RIGHT-CCR5_***DddE(85-178)***_*2xUGI* | 112 |
| TC 32 | LEFT-CCR5_***DddE(41-84)***_*2xUGI* | 104 |
| mito 20 | LEFT-m.14459A_***DddE(41-84)*** | 64 |
| mito 26 | RIGHT-m.14459A-Nt-αN_***DddE(85-178***) | 71 |
| mito 30 | RIGHT-m.14459A-Nt-βN_***DddE(85-178***) | 71 |
| mito 20a | *2xUGI*_LEFT-m.14459A_***DddE(41-84)*** | 88 |
| mito 26a | *2xUGI*_RIGHT-m.14459A-Nt-αN_***DddE(85-178***) | 96 |
| mito 30a | *2xUGI*_RIGHT-m.14459A-Nt-βN_***DddE(85-178***) | 91 |

FIG. 8B

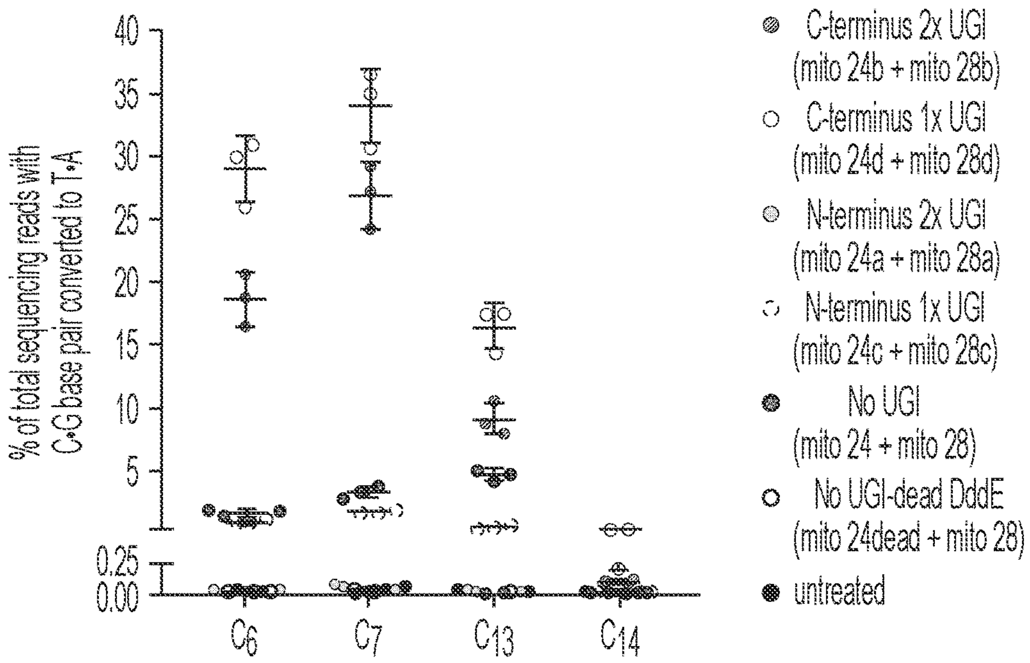
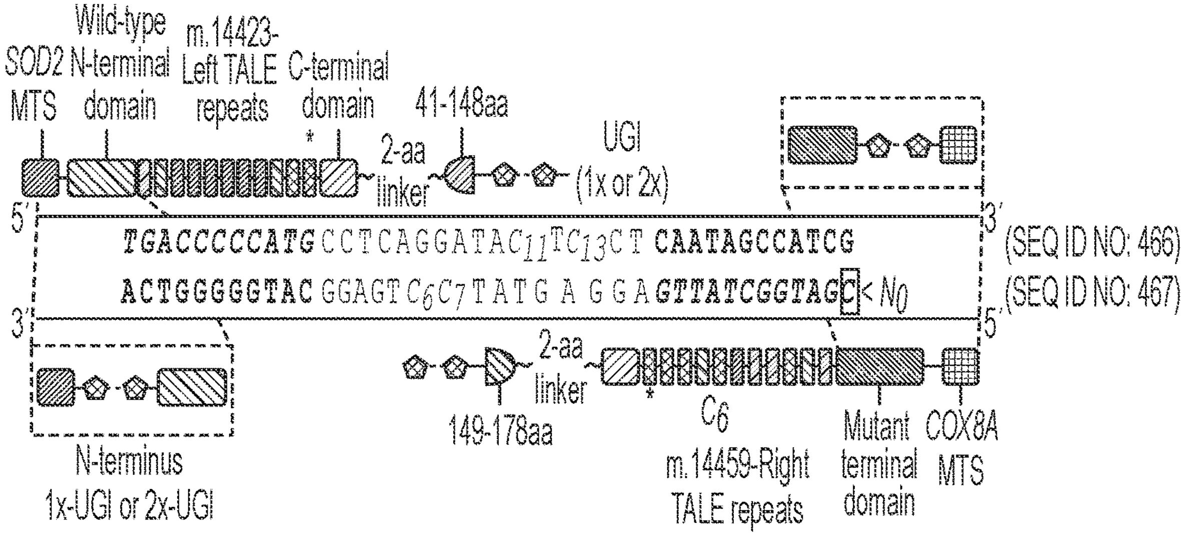
FIG. 12A

| Plasmid | Description | % of C•G to T•A conversion in mitochondrial ND6 gene | Cellular localization |
|---|---|---|---|
| Mito 24 | m.14459a Left TALE -2aa-G148(41-148aa) | 1-5% | Mitochondria |
| Mito 28 | m.14459a-αN-Right TALE -2aa-G148(148-178aa) | | |
| Mito 24a | N′-2xUGI-m.14459a Left TALE -2aa-G148(41-148aa) | N.D. | Diffused throughout cytoplasm |
| Mito 28a | N′-2xUGI-m.14459a-αN-Right TALE -2aa-G148(148-178aa) | | |
| Mito 24b | m.14459a Left TALE -2aa-G148(41-148aa)-C′-2xUGI | 10 - 30% | |
| Mito 28b | m.14459a-αN-Right TALE -2aa-G148(148-178aa)-C′-2xUGI | | |
| Mito 24c | N′-1xUGI-m.14459a Left TALE -2aa-G148(41-148aa) | N.D. | |
| Mito 28c | N′-1xUGI-m.14459a-αN-Right TALE -2aa-G148(148-178aa) | | |
| Mito 24d | m.14459a Left TALE -2aa-G148(41-148aa)-C′-1xUGI | 20-35% | |
| Mito 28d | m.14459a-αN-Right TALE -2aa-G148(148-178aa)-C′-1xUGI | | |

FIG. 13

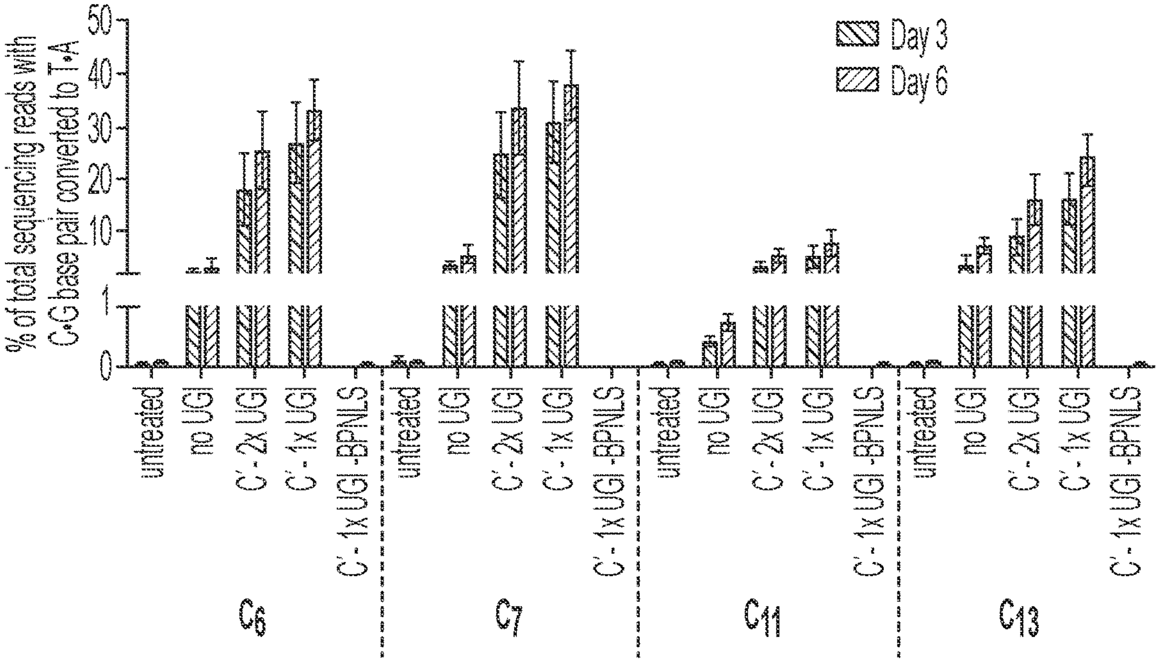
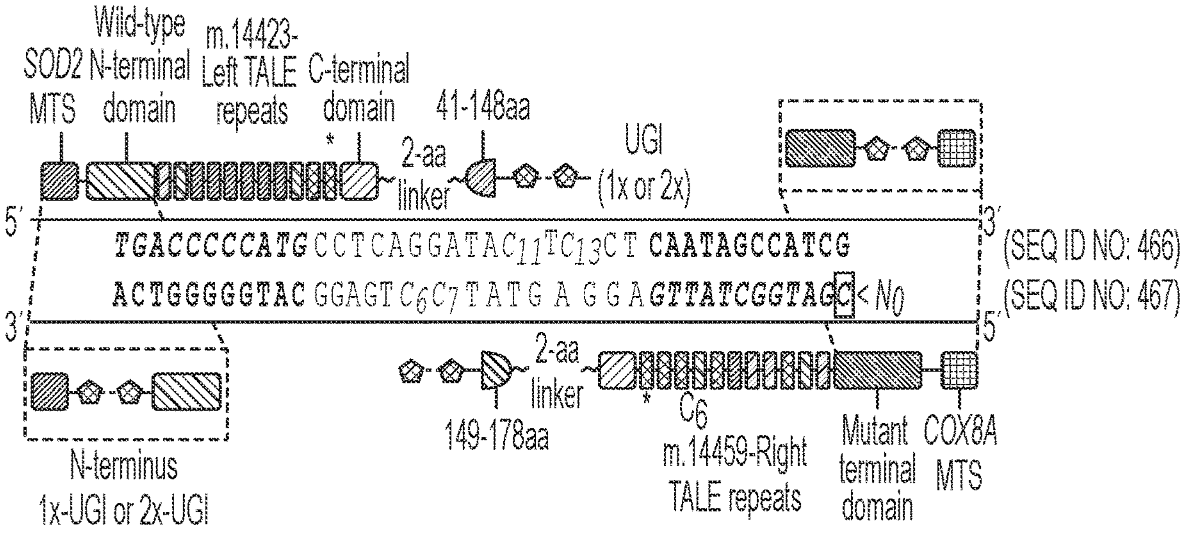
FIG. 16

*ND5* m.13513G>A:

AGCCTAGCATTAGCAGGAATACCTTTCCTCACAGGTTTCTACTCCAAAAACCAC (SEQ ID NO: 472)
TCGGATCGTAATCGTCCTTATGGAAAGGAGTGTCCAAAGATGAGGTTTTTGGTG (SEQ ID NO: 473)

Wild type *ND5*:

AGCCTAGCATTAGCAGGAATACCTTTCCTCACAGGTTTCTACTCCAAAGACCAC (SEQ ID NO: 474)
TCGGATCGTAATCGTCCTTATGGAAAGGAGTGTCCAAAGATGAGGTTTCTGGTG (SEQ ID NO: 475)

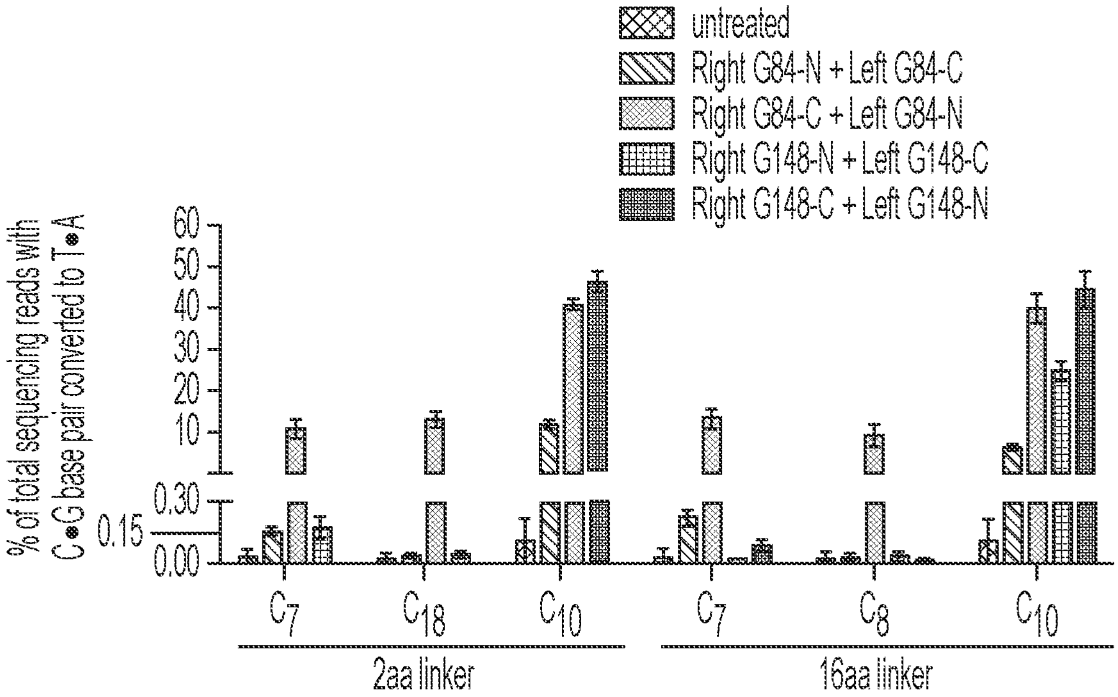
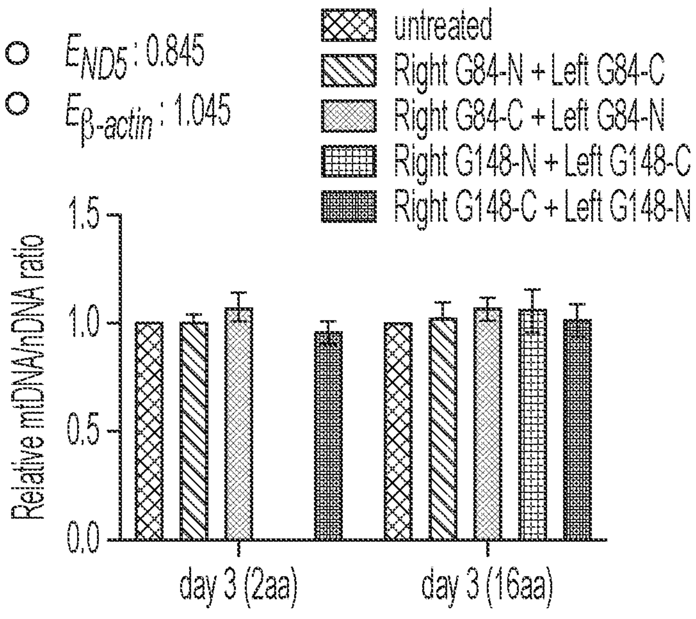
FIG. 20

A | 5′ FAM—A(14)-ACTCGCCA-A(14)—3′ (SEQ ID NO: 196)
3′—T(14)-TGAGCGGT-T(14)—5′ (SEQ ID NO: 525)

B | 5′—A(14)-ACTCGCCA-A(14)—3′ (SEQ ID NO: 196)
3′—T(14)-TGAGCGGT-T(14)—FAM5′ (SEQ ID NO: 525)

| Dead-DdCBEs | | | | TALE-free G1397 $DddA_{tox}$ | | Untreated |
|---|---|---|---|---|---|---|
| ***ND6*** | *ND5.1* | ***ND5.2*** | ATP8 | | | |
| G564A (0.29%) | G6876A (0.10%) | A1625G (0.10%) | G545C (0.09%) | A538C (0.08%) | C8619T (0.07%) | G545C (0.06%) |
| T14403C (0.09%) | T9478A (0.07%) | G6876A (0.08%) | | C660T (0.08%) | C10205T (0.21%) | G972A (0.06%) |
| G6876A (0.10%) | T12145C (0.09%) | G9565A (0.08%) | | G709A (0.16%) | C12632T (0.16%) | G2492A (0.08%) |
| C12632T (0.09%) | C12632T (0.09%) | T12145C (0.11%) | | G1595A (0.25%) | C13763T (0.10%) | T3572C (0.08%) |
| G16391A (0.08%) | T14403C (0.08%) | C14588T (0.18%) | | C4846T (0.24%) | C15598T (0.20%) | C5764T (0.09%) |
| | | | | C6467T (0.30%) | C16363T (0.17%) | G6876A (0.15%) |
| | | | | G7216A (0.10%) | | C14588T (0.15%) |
| | | | | G8115A (0.39%) | | T15184C (0.17%) |
| | | | | C8215T (0.29%) | | G15756A (0.19%) |

| | dsDNA spacing length (bp) | | | |
|---|---|---|---|---|
| | saG1 | saG2 | saG3 | saG4 |
| **spG7** | 28 | 33 | 39 | 60 |
| **spG6** | 12 | 17 | 23 | 44 |

(SEQ ID NO: 549) 5'- CCTGAGTGTTGAGGCCCCAGTGGCTGCTCTGGGGGCCTCCTGAGTTTCTCATCTGTGCCCCTCCCTCCCTGGCCCAGGTGAAGGTGTGGTTCCAGAACCGGAGGACAAAGT-3'
(SEQ ID NO: 550) *spG7* GGACTCACAACTCCGGGGTCACC
(SEQ ID NO: 551) *spG6* GGTCACCGACGAGACCCCCGGAG
(SEQ ID NO: 552) *saG1* TCTGTGCCCCTCCCTCCCTGGC*CCAGGT*
(SEQ ID NO: 553) *saG2* GCCCCTCCCTCCCTGGCCCAGGT*GAAGGT*
(SEQ ID NO: 554) *saG3* CCCTCCCTGGCCCAGGTGAAGG*TGTGGT*
(SEQ ID NO: 555) *saG4* GTGTGGTTCCAGAACCGGAGGA*CAAAGT*

FIG. 41C

Column T from top to bottom (SEQ ID NOs: 574-586)

Column C from top to bottom (SEQ ID NOs: 587-602)

Column A from top to bottom (SEQ ID NOs: 603-618)

Column G from top to bottom (SEQ ID NOs: 619, 620, 589, 621-632)

Second position

| First position | T | C | A | G | Third position |
|---|---|---|---|---|---|
| T | TTT- | TCT-RLRDIQF | TAT-ARGNLRT | TGT - | T |
| T | TTC- | TCC-RSDERKR | TAC-SRGNLKS | TGC-APKALGW | C |
| T | TTA- | TCA-RSDHLTT | TAA-QASNLIS | TGA-QAGHLAS | A |
| T | TTG-RKDALRG | TCG-RLRALDR | TAG-REDNLHT | TGG-RSDHLTT | G |
| C | CTT-TTGALTE | CCT-TKNSLTE | CAT-TSGNLTE | CGT-SRRTCRA | T |
| C | CTC-QRHHLVE | CCC-SKKHLAE | CAC-SKKALTE | CGC-HTGHLLE | C |
| C | CTA-QNSTLTE | CCA-TSHSLTE | CAA-QSGNLTE | CGA-QSGHLTE | A |
| C | CTG-RNDALTE | CCG-RNDTLTE | CAG-RADNLTE | CGG-RSDKLTE | G |
| A | ATT-HKNALQN | ACT-THLDLIR | AAT-TTGNLTV | AGT-HRTTLTN | T |
| A | ATC-RRSACRR | ACC-DKKDLTR | AAC-DSGNLRV | AGC-ERSHLRE | C |
| A | ATA-QKSSLIA | ACA-SPADLTR | AAA-QRANLRA | AGA-QLAHLRA | A |
| A | ATG-RRDELNV | ACG-RTDTLRD | AAG-RKDNLKN | AGG-RSDHLTN | G |
| G | GTT-TSGSLVR | GCT-TSGELVR | GAT-TSGNLVR | GGT-TSGHLVR | T |
| G | GTC-DPGALVR | GCC-DCRDLAR | GAC-DPGNLVR | GGC-DPGHLVR | C |
| G | GTA-QSSSLVR | GCA-QSGDLRR | GAA-QSSNLVR | GGA-QRAHLER | A |
| G | GTG-RSDELVR | GCG-RSDDLVR | GAG-RSDNLVR | GGG-RSDKLVR | G |

FIG. 66

FIG. 67
DddA (N/C)
5xZnF-4-R8
ZF5 ZF4 ZF3 ZF2 ZF1 -N
(SEQ ID NO: 633)
CAAACTACCACCTACCTCCCTCACCAAAGCCCATAAAAATAAAAAATTATAAC
GTTTGATGGTGGATGGAGGGAGTGGTTTCGGGTATTTTTATTTTTTAATATTG
(SEQ ID NO: 634)
N- ZF1 ZF2 ZF3 ZF4 ZF5
DddA (N/C)
R8
4bp editing window
DddA (N/C)
5xZnF-18-R8
ZF5 ZF4 ZF3 ZF2 ZF1 -N
(SEQ ID NO: 633)
CAAACTACCACCTACCTCCCTCACCAAAGCCCATAAAAATAAAAAATTATAAC
GTTTGATGGTGGATGGAGGGAGTGGTTTCGGGTATTTTTATTTTTTAATATTG
(SEQ ID NO: 634)
N- ZF1 ZF2 ZF3 ZF4 ZF5
DddA (N/C)
R8
18bp editing window

N-terminal MTS and NES:

- v1 = MTS + NES + 2aa linker
- Link7 = MTS + NES + 7aa linker
- Link13 = MTS + NES + 13aa linker
- XTEN = MTS + NES + 33aa linker N-terminal MTS and C-terminal NES

- MTS1,NES1 = MTS1 + NES1 + 2aa linker
- MTS1,NES2 = MTS1 + NES2 + 2aa linker
- MTS2,NES1 = MTS2 + NES1 + 2aa linker
- MTS2,NES2 = MTS2 + NES2 + 2aa linker

[NB MTS ≠ MTS1]

BASE EDITORS, COMPOSITIONS, AND METHODS FOR MODIFYING THE MITOCHONDRIAL GENOME

RELATED APPLICATIONS

This application is a national stage filing under 35 U.S.C. § 371 of International PCT Application PCT/US2021/015580, filed Jan. 28, 2021, which claims priority under 35 U.S.C. § 119(e) to U.S. Provisional Application, U.S. Ser. No. 62/967,027, filed on Jan. 28, 2020, and to U.S. Provisional Application, U.S. Ser. No. 63/038,741, filed on Jun. 12, 2020, each of which is incorporated herein by reference.

GOVERNMENT SUPPORT

This invention was made with government support under Grant Nos. AI080609, AI142756, DK089507. GM 118062. GM122455, and HG009490 awarded by the National Institutes of Health, and Grant No. HDTRA-1-13-1-0014 awarded by the Department of Defense. The government has certain rights in the invention.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Aug. 23, 2022, is named B 119570084US03-SUBSEQ-TNG and is 1,627,926 bytes in size.

BACKGROUND OF THE INVENTION

Inherited or acquired mutations in mitochondrial DNA (mtDNA) can profoundly impact cell physiology and are associated with a spectrum of human diseases, ranging from rare inborn errors of metabolism,[4] certain cancers,[5] age-associated neurodegeneration,[6] and even the aging process itself.[7,8] Tools for introducing specific modifications to mtDNA are needed both for modeling diseases and for their therapeutic potential. The development of such tools, however, has been constrained in part by the challenge of transporting RNAs into mitochondria, including guide RNAs required to facilitate nucleic acid modification and/or editing using CRISPR-associated proteins.[9]

Each mammalian cell contains hundreds to thousands of copies of circular mtDNA.[10] Homoplasmy refers to a state in which all mtDNA molecules are identical, while heteroplasmy refers to a state in which a cell contains a mixture of wild-type and mutant mtDNA. Current approaches to engineering and/or altering mtDNA rely on RNA-free DNA-binding proteins, such as transcription activator-like effectors nucleases (mitoTALENs)[11-17] and zinc finger nucleases fused to mitochondrial targeting sequences (mitoZFNs), to induce double-strand breaks (DSBs).[18-20] Upon cleavage, the linearized mtDNA is rapidly degraded,[21-23] resulting in heteroplasmic shifts to favor uncut mtDNA genomes. As a candidate therapy however, this approach cannot be applied to homoplasmic mtDNA mutations[24] since destroying all mtDNA copies is presumed to be harmful.[22,25] In addition, using DSBs to eliminate heteroplasmic mtDNA mutations, which tend to be functionally recessive,[26] implicitly requires the edited cell to restore its wild-type mtDNA copy number. During this transient period of mtDNA repopulation, the loss of mtDNA copies could cause cellular toxicity resulting in deleterious effects (e.g., apoptosis).

A favorable alternative to targeted destruction of DNA through DSBs is precision genome editing, a capability that has not yet been reported for mtDNA. The ability to precisely install or correct pathogenic mutations, rather than destroy targeted mtDNA, could accelerate our ability to model mtDNA diseases in cells and animal models, and in principle could also enable therapeutic approaches that correct pathogenic mtDNA mutations.

Therefore, the development of programmable base editors that are capable of introducing a nucleotide change and/or which could alter or modify the nucleotide sequence at a target site with high specificity and efficiency within the mtDNA would substantially expand the scope and therapeutic potential of genome editing technologies.

SUMMARY

The present disclosure relates in part to the inventors' discovery of a double-stranded DNA deaminase, referred to herein as "DddA," and to its application in base editing of double-stranded nucleic acid molecules, and in particular, the editing of mitochondrial DNA.

Inherited or acquired mutations in mitochondrial DNA (mtDNA) can profoundly impact cell physiology and are associated with a spectrum of human diseases, ranging from rare inborn errors of metabolism,[4] certain cancers,[5] age-associated neurodegeneration,[6] and even the aging process itself.[7,8] Tools for introducing specific modifications to mtDNA are urgently needed both for modeling diseases and for their therapeutic potential. The present disclosure provides such tools through the use of the newly discovered DddA and variants thereof (e.g., split variants) described herein in base editing of mtDNA, and other double-stranded DNA targets.

Each mammalian cell contains hundreds to thousands of copies of a circular mtDNA[10]. Homoplasmy refers to a state in which all mtDNA molecules are identical, while heteroplasmy refers to a state in which a cell contains a mixture of wild-type and mutant mtDNA. Current approaches to engineer mtDNA rely on DNA-binding proteins such as transcription activator-like effectors nucleases (mitoTALENs) [11-17] and zinc finger nucleases (mitoZFNs)[18-20] fused to mitochondrial targeting sequences to induce double-strand breaks (DSBs). Such proteins do not rely on nucleic acid programmability (e.g., such as with Cas9 domains). Linearized mtDNA is rapidly degraded,[21-23] resulting in heteroplasmic shifts to favor uncut mtDNA genomes. As a candidate therapy however, this approach cannot be applied to homoplasmic mtDNA mutations[24] since destroying all mtDNA copies is presumed to be harmful.[22,25] In addition, using DSBs to eliminate heteroplasmic mtDNA mutations, which tend to be functionally recessive,[26] implicitly requires the edited cell to restore its wild-type mtDNA copy number. During this transient period of mtDNA repopulation, the loss of mtDNA copies could result in cellular toxicity.

As described herein, the disclosure provides a novel platform of precision genome editing using a double-stranded DNA deaminase and a programmable DNA binding protein, such as a TALE domain, zinc finger binding domain, or a napDNAbp (e.g., Cas9), to target the deamination of a target base, which through cellular DNA repair and/or replication, is converted to a new base, thereby installing a base edit at a target site. In some embodiments, the deaminase activity is a cytidine deminase, which deaminates a cytidine, leading to a C-to-T edit at that site. In some other embodiments, that deaminase activity is an adenosine deminase, which deaminates an adenosine, leading to a A-to-G edit at that site. In various embodiments, the disclosure further relates to "split-constructs" and "split-delivery" of said constructs whereby to address the toxic nature of fully active DddA in cells (as discovered by the inventors), the DddA protein is "split" or otherwise divided into two or more DddA fragments which can be separately delivered, expressed, or otherwise provided to cells to avoid the toxicity of fully active DddA. Further, the DddA fragments may be delivered, expressed, or otherwise provided as separate fusion proteins to cells with programmable DNA binding proteins (e.g., zinc finger domains. TALE domains, or Cas9 domains) which are programmed to localize the DddA fragments to a target edit site, through the binding of the DNA binding proteins to DNA sites upstream and downstream of the target edit site. Once co-localized to the target edit site, the separately provided DddA fragments may associate (covalently or non-covalently) to reconstitute an active DddA protein with a double-stranded DNA deaminase activity. In certain embodiments where the objective is to base edit mitochondrial DNA targets, the programmable DNA binding proteins can be modified with one or more mitochondrial localization signals (MLS) so that the DddA-pDNAbp fusions are translocated into the mitochondria, thereby enabling them to act on mtDNA targets.

The inventors are believed to be the first to identify DddA, initially being discovered as a bacterial toxin. The inventors further conceived of the idea of splitting the DddA into two or more domains, which apart do not have a deaminase activity (and as such, lack toxicity), but which may be reconstituted (e.g., inside the cell, and/or inside the mitochondria) to restore the deaminase activity of the protein. This allows the separate delivery DddA fragments to cells (and/or to mitochondria, specifically), or delivery of nucleic acid molecules expressing such DddA fragments to a cell, such that once present or expressed within a cell, DddA fragments may associate with one another. By "associate" it is meant the two or more DddA fragments may come into contact with one another (e.g., in a cell, or within a mitochondria) and form a functional DddA protein within a cell (or mitochondria). The association of the two or more fragments may be through covalent interactions or non-covalent interactions. In addition, the DddA domains may be fused or otherwise non-covalently linked to a programmable DNA binding protein, such as a Cas9 domain or other napDNAbp domain, zinc finger domain or protein (ZF, ZFD, or ZFP), or a transcription activator-like effector protein (TALE), which allows for the co-localization of the two or more DddA fragments to a particular desired site in a target nucleic acid molecule which is to be edited, such that when the DddA fragments are co-localized at the desired editing site, they reform a functional DddA that is capable deaminating a target site on a double-stranded DNA molecule. In certain embodiments, the programmable DNA binding proteins can be engineered to comprise one or more mitochondrial localization signals (MLS) such the DddA domains become translocated into the mitochondria, thereby providing a means by which to conduct base editing directly on the mitochondrial genome.

Accordingly, provided herein are compositions, kits, and methods of modifying double-stranded DNA (e.g., mitochondrial DNA or "mtDNA") using genome editing strategies that comprise the use of a programmable DNA binding protein ("pDNAbp") (e.g., a mitoTALE, mitoZFP, or a CRISPR/Cas9) and a double-stranded DNA deaminase ("DddA") to precisely install nucleotide changes and/or correct pathogenic mutations in double-stranded DNA (e.g., mtDNA), rather than destroying the DNA (e.g., mtDNA) with double-strand breaks (DSBs). The present disclosure provides pDNAbp polypeptides, DddA polypeptides, fusion proteins comprising pDNAbp polypeptides and DddA polypeptides, nucleic acid molecules encoding the pDNAbp polypeptides, DddA polypeptides, and fusion proteins described herein, expression vectors comprising the nucleic acid molecules described herein, cells comprising the nucleic acid molecules, expression vectors, pDNAbp polypeptides, DddA polypeptides, and/or fusion proteins described herein, pharmaceutical compositions comprising the polypeptides, fusion proteins, nucleic acid molecules, vectors, or cells described herein, and kits comprising the polypeptides, fusion proteins, nucleic acid molecules, vectors, or cells described herein for modifying double-stranded DNA (e.g., mtDNA) by base editing.

In some embodiments, the pDNAbps (e.g., a mitoTALE, mitoZFP, or a CRISPR/Cas) and the DddAs are expressed as fusion proteins. In other embodiments, the pDNAbps and DddAs are expressed as separate polypeptides. In various other embodiments, the fusion proteins and/or the separately expressed pDNAbps and DddAs become translocated into the mitochondria. To effect translocation, the fusion proteins and/or the separately expressed pDNAbps and DddAs can comprise one or more mitochondrial targeting sequences (MTS).

In still other embodiments, the DddA is administered to a cell in which mitochondrial base editing is desired as two or more fragments, wherein each fragment by itself is inactive with respect to deaminase activity, but upon co-localization in the cell, e.g., inside the mitochondria, the two or more fragments reconstitute the deaminase activity.

In certain embodiments, the reconstituted activity of the co-localized two or more fragments can comprise at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or at least 99.9% of the deaminase activity of a wildtype DddA.

In certain embodiments, the DddA is separated into two fragments by dividing the DddA at a split site. A "split site" refers to a position between two adjacent amino acids (in a wildtype DddA amino acid sequence) that marks a point of division of a DddA. In certain embodiments, the DddA can have at least one split site, such that once divided at that split site, the DddA forms an N-terminal fragment and a C-terminal fragment. The N-terminal and C-terminal fragments can be the same or different sizes (or lengths), wherein the size and/or polypeptide length depends on the location or position of the split site. As used herein, reference to a "fragment" of DddA (or any other polypeptide) can be referred equivalently as a "portion." Thus, a DddA which is divided at a split site can form an N-terminal portion and a C-terminal portion. Preferably, the N-terminal fragment (or portion) and the C-terminal fragment (or portion) or DddA do not have deaminase activity, or have a reduced deaminase activity that is reduced by at least 10%, or at least 15%, or at least 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or up to 100% relative to the wild type DddA activity.

In various embodiments, a DddA may be split into two or more inactive fragments by directly cleaving the DddA at one or more split sites. Direct cleaving can be carried out by a protease (e.g., trypsin) or other enzyme or chemical reagent. In certain embodiments, such chemical cleavage reactions can be designed to be site-selective (e.g., Elashal and Raj, "Site-selective chemical cleavage of peptide bonds," *Chemical Communications,* 2016, Vol. 52, pages 6304-6307, the contents of which are incorporated herein by reference.) In other embodiments, chemical cleavage reactions can be designed to be non-selective and/or occur in a random fashion.

In other embodiments, the two or more inactive DddA fragments can be engineered as separately expressed polypeptides. For instance, for a DddA having one split site, the N-terminal DddA fragment could be engineered from a first nucleotide sequence that encodes the N-terminal DddA fragment (which extends from the N-terminus of the DddA up to and including the residue on the amino-terminal side of the split site). In such an example, the C-terminal DddA fragment could be engineered from a second nucleotide sequence that encodes the C-terminal DddA fragment (which extends from the carboxy-terminus of the split site up to including the natural C-terminus of the DddA protein). The first and second nucleotide sequences could be on the same or different nucleotide molecules (e.g., the same or different expression vectors).

In various embodiments, the N-terminal portion of the DddA may be referred to as "DddA-N half" and the C-terminal portion of the DddA may be referred to as the "DddA-C half." Reference to the term "half" does not connote the requirement that the DddA-N and DddA-C portions are identically half of the size and/or sequence length of a complete DddA, or that the split site is required to be at the mid point of the complete DddA polypeptide. To the contrary, and as noted above, the split site can be between any pair of residues in the DddA polypeptide, thereby giving rise to half portions which are unequal in size and/or sequence length. In certain embodiments, the split site is within a loop region of the DddA.

Accordingly, in one aspect, the disclosure relates to a pair of fusion proteins useful for making modifications to the sequence of mitochondrial DNA (e.g., mtDNA). The pair of fusion proteins, in some embodiments, can comprise a first fusion protein comprising a first pDNAbp (e.g., a mitoTALE, mitoZFP, or a CRISPR/Cas9) and a first portion or fragment of a DddA, and a second fusion protein comprising a second pDNAbp (e.g., mitoTALE, mitoZFP, or a CRISPR/Cas9) and a second portion or fragment of a DddA, such that the first and the second portions of the DddA reconstitute a DddA upon co-localization in a cell and/or mitochondria. In certain embodiments, that first portion of the DddA is an N-terminal fragment of a DddA and the second portion of the DddA is C-terminal fragment of a DddA. In other embodiments, the first portion of the DddA is a C-terminal fragment of a DddA and the second portion of the DddA is an N-terminal fragment of a DddA. In this aspect, the structure of the pair of fusion proteins can be, for example:

[pDNAbp]-[DddA half$^A$] and [pDNAbp]-[DddA half$^B$];
[DddA-half$^A$]-[pDNAbp] and [DddA-half$^B$]-[pDNAbp];
[pDNAbp]-[DddA half$^A$] and [DddA-half$^B$]-[pDNAbp]; or
[DddA-half$^A$]-[pDNAbp] and [pDNAbp]-[DddA half$^B$], wherein "A" or "B" can be the N-terminal or C-terminal half of DddA.

In another aspect, the disclosure relates to a pair of fusion proteins useful for making modifications to the sequence of mitochondrial DNA (e.g., mtDNA). The pair of fusion proteins can comprise a first fusion protein comprising a first mitoTALE and a first portion or fragment of a DddA, and a second fusion protein comprising a second mitoTALE and a second portion or fragment of a DddA, such that the first and the second portions of the DddA, upon co-localization in a cell and/or mitochondria, are reconstituted as an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoTALE]-[DddA half$^A$] and [mitoTALE]-[DddA half$^B$];
[DddA-half$^A$]-[pDNAbp] and [DddA-half$^B$]-[mitoTALE];
[mitoTALE]-[DddA half$^A$] and [DddA-half$^B$]-[mitoTALE]; or
[DddA-half$^A$]-[mitoTALE] and [mitoTALE]-[DddA half$^B$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first mitoZFP and a first portion or fragment of a DddA, and a second fusion protein comprising a second mitoZFP and a second portion or fragment of a DddA, such that the first and the second portions of the DddA, upon co-localization in a cell and/or mitochondria, are reconstituted as an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoZFP]-[DddA half$^A$] and [mitoZFP]-[DddA half$^B$];
[DddA-half$^A$]-[pDNAbp] and [DddA-half$^B$]-[mitoZFP];
[mitoZFP]-[DddA half$^A$] and [DddA-half$^B$]-[mitoZFP]; or
[DddA-half$^A$]-[mitoZFP] and [mitoZFP]-[DddA half$^B$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first Cas9 domain and a first portion or fragment of a DddA, and a second fusion protein comprising a second Cas9 domain and a second portion or fragment of a DddA, such that the first and the second portions of the DddA, upon co-localization in a cell and/or mitochondria, are reconstituted as an active DddA. In certain embodiments, that first portion of the DddA is an N-terminal fragment of a DddA (i.e., "DddA half$^A$" as shown in FIGS. 1A-1E) and the second portion of the DddA is C-terminal fragment of a DddA (i.e., "DddA half$^B$" as shown in FIGS. 1A-IE). In other embodiments, the first portion of the DddA is an C-terminal fragment of a DddA and the second portion of the DddA is an N-terminal fragment of a DddA. In this aspect, the structure of the pair of fusion proteins can be, for example:

[Cas9]-[DddA half$^{A}$] and [Cas9]-[DddA half$^{B}$];
[DddA-half$^{A}$]-[Cas9] and [DddA-half$^{B}$]-[Cas9];
[Cas9]-[DddA half$^{A}$] and [DddA-half$^{B}$]-[Cas9]; or
[DddA-half$^{A}$]-[Cas9] and [Cas9]-[DddA half$^{B}$], wherein "A" or "B" can be the N-terminal or C-terminal half of DddA.

In each instance above of "]-[" can be in reference to a linker sequence.

In some embodiments, a first fusion protein comprises, a first mitochondrial transcription activator-like effector (mitoTALE) domain and a first portion of a DNA deaminase effector (DddA). In some embodiments, the first portion of the DddA comprises an N-terminal truncated DddA. In some embodiments, the first mitoTALE domain is configured to bind a first nucleic acid sequence proximal to a target nucleotide. In some embodiments, the first portion of a DddA is linked to the remainder of the first fusion protein by the C-terminus of the first portion of a DddA.

In some embodiments, a second fusion protein comprises, a second mitoTALE domain and a second portion of a DddA. In some embodiments, the second portion of the DddA comprises a C-terminal truncated DddA. In some embodiments, the second mitoTALE domain is configured to bind a second nucleic acid sequence proximal to a nucleotide opposite the target nucleotide. In some embodiments, the second portion of a DddA is linked to the remainder of the second fusion protein by the C-terminus of the second portion of a DddA.

In some embodiments, the first or second fusion protein is the result of truncations of a DddA at a residue site selected from the group comprising: 62, 71, 73, 84, 94, 108, 110, 122, 135, 138, 148, and 155. In some embodiments, the first or second fusion protein is the result of truncations of a DddA at a residue 148.

In some embodiments, the first or second fusion protein further comprises a linker. In some embodiments, the linker is positioned between the first mitoTALE and the first portion of a DddA and/or between the second mitoTALE and the second portion of a DddA. In some embodiments, the linker is at least two amino acids and no greater than sixteen amino acid residues in length. In some embodiments, the linker is two amino acid residues.

In some embodiments, the first or second fusion protein further comprises at least one uracil glycosylase inhibitor. In some embodiments, the first or second fusion protein the at least one glycosylase inhibitor is attached to the C-terminus of the first and/or second portion of a DddA.

In another aspect, the disclosure relates to a pair of fusion proteins comprising: (a) a first fusion protein disclosed herein; and (b) a second fusion protein disclosed herein, wherein the first pDNAbp (e.g., mitoTALE, mitoZFP, or mitoCas9) of the first fusion protein is configured to bind a first nucleic acid sequence proximal to a target nucleotide and the second pDNAbp (e.g., mitoTALE, mitoZFP, or mitoCas9) of the second fusion protein is configured to bind a second nucleic acid sequence proximal to a nucleotide opposite the target nucleotide. In some embodiments, the first nucleic acid sequence of the pair of fusion proteins is upstream of the target nucleotide and the second nucleic acid of the pair of fusion proteins is upstream of a nucleic acid of the complementary nucleotide.

In another aspect the disclosure relates to a pair of fusion proteins, wherein the first and second fusion proteins disclosed herein, are configured to form a dimer, and dimerization of the first and second fusion proteins at closely spaced nucleic acid sequences reconstitutes at least partial activity of a full length DddA. In some embodiments, the dimerization of the pair of fusion proteins facilitates deamination of the target nucleotide.

In another aspect, the disclosure relates to a recombinant vector comprising an isolated nucleic acid as disclosed herein.

In some embodiments, the vector is part of a composition, the composition comprising the vector and a pharmaceutically acceptable excipient.

In another aspect, the disclosure relates to an isolated cell comprising a nucleic acid as disclosed. In some embodiments, the isolated cell is a mammalian cell. In some embodiments, the mammalian cell is a human cell.

In another aspect, the disclosure relates to a method of treating a subject having, at risk of having, or suspected of having, a disorder comprising administering an effective amount of a pair of fusion proteins as described herein, a nucleic acid as described herein, a vector as disclosed herein, a composition as described herein, and/or an isolated cell as described herein. For example, the disorder can be a mitochondrial disorder, such as, MELAS/Leigh syndrome or Leber's hereditary optic neuropathy.

In another aspect, the disclosure relates to a method of editing a nucleic acid in a subject, comprising: (a) determining a target nucleotide to be deaminated: (b) configuring the first fusion protein to bind proximally to the target nucleotide; (c) configuring a second fusion protein to bind proximally to a nucleotide opposite to the target nucleotide; and (d) administering an effective amount of the first and second fusion proteins, wherein, the first mitoTALE binds proximally to the target nucleotide and the second mitoTALE binds proximally to the nucleotide opposite the target nucleotide, and wherein the first portion of a DddA dimerizes with the second portion of a DddA, wherein the dimer has at least some activity native to full length DddA, and wherein the activity deaminates the target nucleotide.

In some embodiments, the disorder treated by the methods described herein is a genetic disorder. In some embodiments, the genetic disorder is a mitochondrial genetic disorder. In some embodiments, the mitochondrial disorder is selected from: MELAS/Leigh syndrome and Leber's hereditary optic neuropathy. In some embodiments, the mitochondrial disorder is MELAS/Leigh syndrome. In some embodiments, the mitochondrial disorder is Leber's hereditary optic neuropathy.

In some embodiments, the subject treated by the methods described herein is a mammal. In some embodiments, the mammal is human.

In another aspect, the disclosure relates to a kit comprising the first and/or second fusion proteins as disclosed herein, the pair of fusion proteins as disclosed herein, the dimer as disclosed herein, the nucleic acids as disclosed herein, the vector as disclosed herein, the composition as disclosed herein, and/or the isolated cell as disclosed herein. The vector may be an AAV vector (e.g., AAV1. AAV2, AAV3, AAV4, AAV5, AAV6, AAV7, AAV8, AAV9, or other serotype), a lentivirus vector, and may include one or more promoters that regulate the expression of the nucleotide sequences encoding the pair of fusion proteins.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein.

All previously described cytidine deaminases, including those used in base editing, operate on single-stranded DNA and thus when used for genome editing require unwinding of double-stranded DNA by macromolecules such as CRISPR-Cas9 complexed with a guide RNA. The difficulty of delivering guide RNAs into the mitochondria has thus far precluded base editing in mitochondrial DNA (mtDNA). The ability of DddA to deaminate double-stranded DNA raises the possibility of RNA-free precision base editing, rather than simple elimination of targeted mtDNA copies following double-strand DNA breaks. Split-DddA halves were engineered that are non-toxic and inactive until brought together on target DNA by adjacently bound programmable DNA-binding proteins. Fusions of the split-DddA halves. TALE array proteins, and uracil glycosylase inhibitor resulted in RNA-free DddA-derived cytosine base editors (DdCBEs) that catalyze C•G-to-T•A conversions efficiently and with high DNA sequence specificity and product purity at targeted sites within mtDNA in human cells.

DddA-mediated base editing was used to model a disease-associated mtDNA mutation in human cell lines, resulting in changes in rates of respiration and oxidative phosphorylation. CRISPR-free, DddA-mediated base editing enables precision editing of mtDNA, with important basic science and biomedical implications.

Figure 1A:
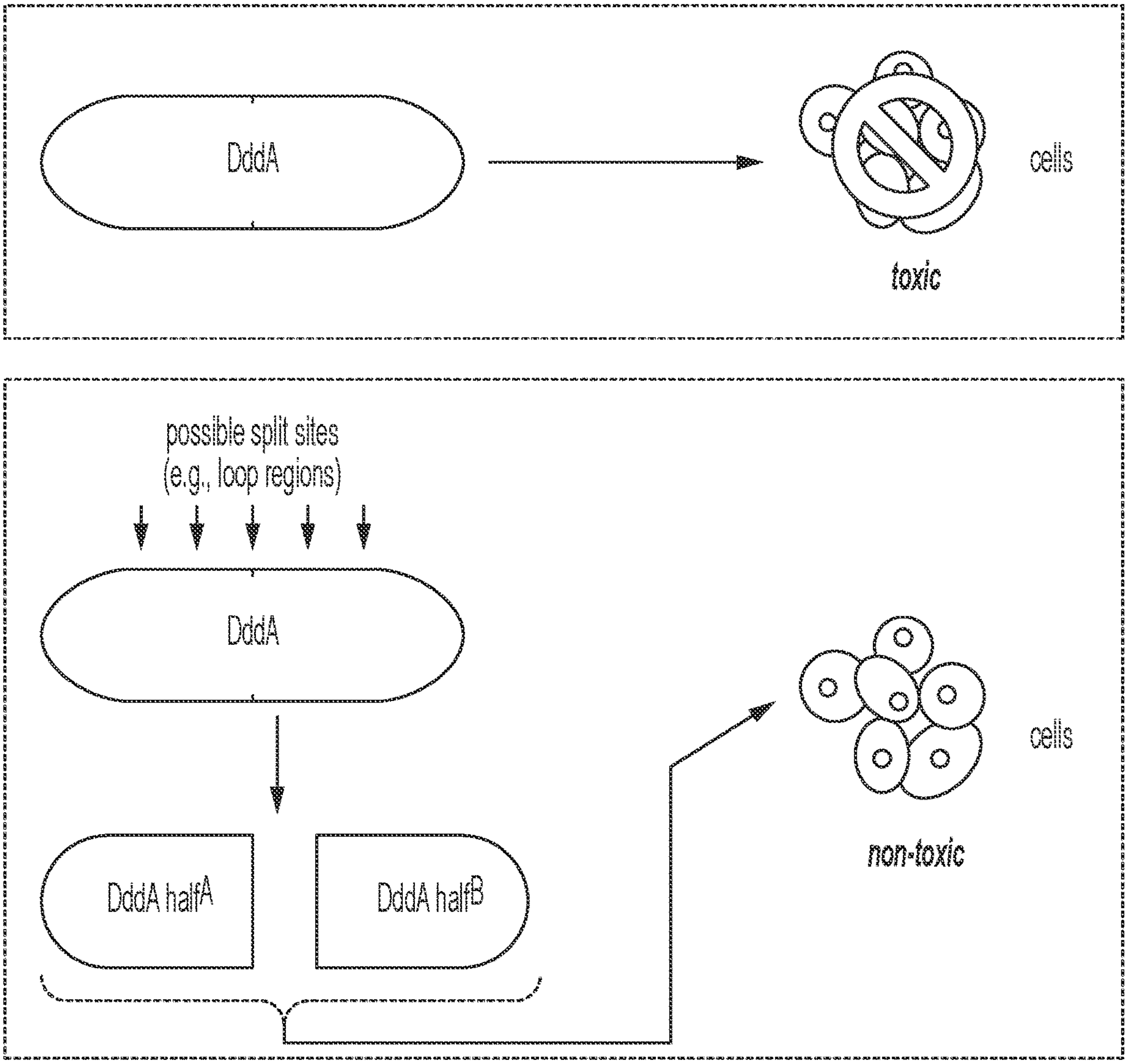

FIG. 1A is a schematic representation of a naturally occurring interbacterial toxin discovered by the inventors and catalyzes unprecedented deamination of cytidines within double-stranded DNA as a substrate. The protein is referred to as a double-stranded DNA deaminase, which is referred to herein as a "DddA." The inventors are believed to be the first to identify such a deaminase. However, in its naturally occurring form, the inventors discovered that DddA is toxic to cells. The inventors have conceived of the idea of using the DddA in the context of base editing to deaminate a nucleobase at a target edit site.

In the context of base editing, all previously described cytidine deaminases utilize single-stranded DNA as a substrate (e.g., the R-loop region of a Cas9-gRNA/dsDNA complex). Base editing in the context of mitochondrial DNA has not heretofore been possible due to the challenges of introducing and/or expressing the gRNA needed for a Cas9-based system into mitochondria. The inventors have recognized for the first time that the catalytic properties of DddA can be leveraged to conduct base editing directly on a double strand DNA substrate by separating the DddA into inactive portions, which when co-localized within a cell will become reconstituted as an active DddA. This avoids or at least minimizes the toxicity associated with delivering and/or expressing a fully active DddA in a cell. For example, a DddA may be divided into two fragments at a "split site," i.e., a peptide bond between two adjacent residues in the primary structure or sequence of a DddA. The split site may be positioned anywhere along the length of the DddA amino acid sequence, so long as the resulting fragments do not on their own possess a toxic property (which could be a complete or partial deaminase activity). In certain embodiments, the split site is located in a loop region of the DddA protein. In the embodiment shown in FIG. 1A, the arrows depict five possible split sites approximately equally spaced along the length of the DddA protein. The depicted embodiment further shows that the DddA was divided into two fragments at a split site located approximately in the middle of the DddA amino acid sequence. The DddA fragment lying to the left of the split site may be referred to as the "N-terminal DddA half" and the DddA fragment lying to the right of the split site may be referred to as the "C-terminal DddA half." FIG. 1A identifies these fragments as "DddA half$^{A}$" and DddA half$^{B}$," respectively. Depending on the location of the split site, the N-terminal DddA half and the C-terminal DddA half could be the same size, approximately the same size, or very different sizes.

Figure 1B:
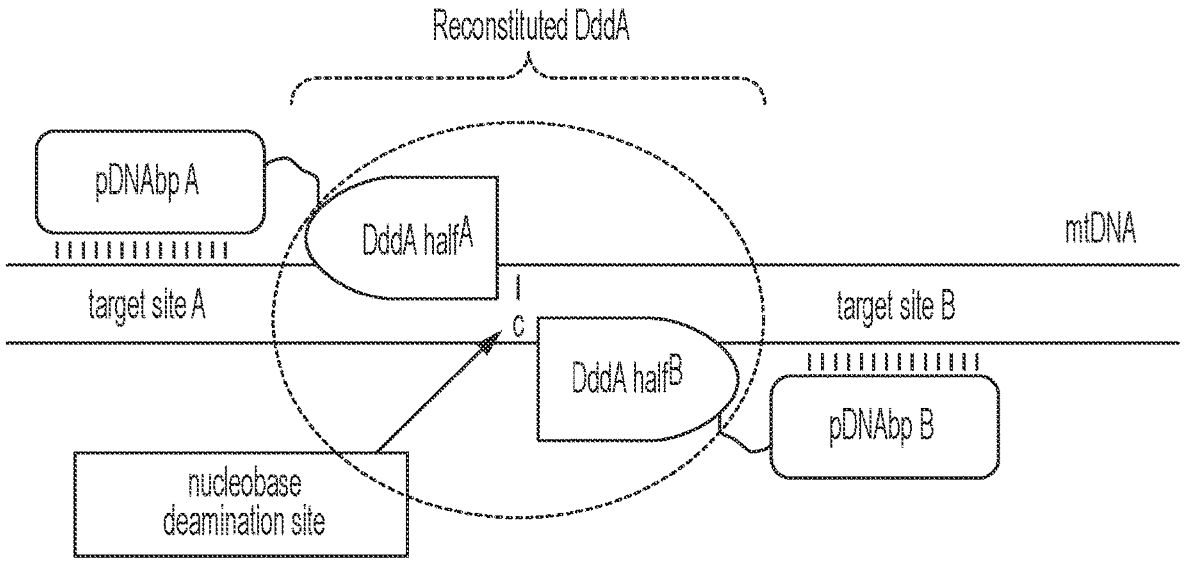

FIG. 1B depicts a pair of mtDNA base editors each comprising a pDNAbp (pDNAbp A and pDNAbp B) fused to an inactive fragment of DddA (DddA half$^{A}$ and DddA half$^{B}$). The pDNAbp components bind to their cognate target sites (target site A and target site B) on the mtDNA, thereby localizing the inactive DddA fragments at the target edit/deamination site. Once localized, the DddA activity is restored. It should be noted, that while the pDNAbpA is shown binding to a target site which is physically arranged on the same side of the deamination site as the DddA half$^{A}$, the DddA half$^{A}$ may be physically arranged so that it approaches the deamination site (e.g., for reconstitution) from any side (e.g., same side, top, opposite side, bottom, or any other angle to the deamination site (e.g., off-axis)) such that it may reconstitute with its DddA half$^{B}$. Additionally, while the figure shows the pDNAbpA and pDNAbpB binding to target sites on opposite sides of the deamination site, it can be readily envisioned that in view of the aforementioned description regarding orientation, that the two pDNAbp (e.g., A and B) may bind on the same side of the deamination site or opposite sides, provided that the DddA halves may reconstitute and effect deamination at the deamination site. Moreover, while the figure shows the pDNAbpA and pDNAbpB binding to target sites on opposite strands of the DNA duplex, it can be readily envisioned that in view of the aforementioned description regarding orientation, that the two pDNAbp (e.g., A and B) may bind on the same strand of the DNA duplex or opposite strands, provided that the DddA halves may reconstitute and effect deamination at the deamination site. Using these premises, it can readily be envisioned that in some embodiments, the DddA halves are oriented in any position relative to the deamination site such that they effectuate deamination, and further that the pDNAbp to which they are linked may be on the same side or different side of the deamination site, and in some embodiments, such pDNAbp of each of the DddA halves are on the same side of the deamination site, on different sides of the deamination site, are on the same strand of the DNA duplex, or on different strands of the DNA duplex.

Figure 1C:
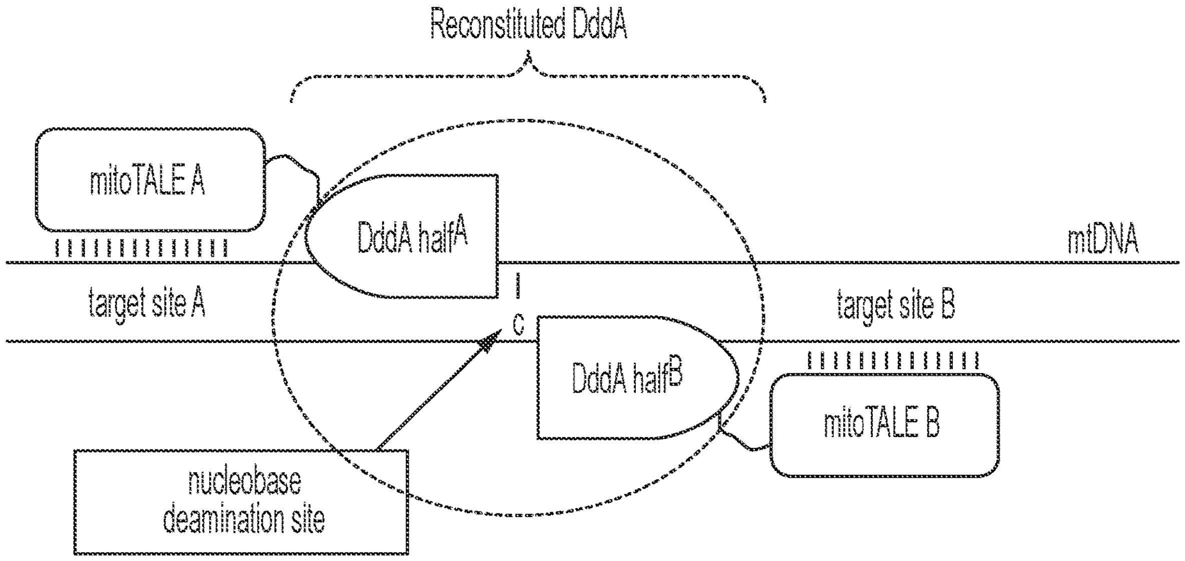

FIG. 1C depicts a pair of mtDNA base editors each comprising a mitoTALE (mitoTALE A and mitoTALE B) fused to an inactive fragment of DddA (DddA half$^{A}$ and DddA half$^{B}$). The mitoTALE components bind to their cognate target sites (target site A and target site B) on the mtDNA, thereby localizing the inactive DddA fragments at the target edit/deamination site. Once localized, the DddA activity is restored. It should be noted, that while the mitoTALEA is shown binding to a target site which is physically arranged on the same side of the deamination site as the DddA half$^{A}$, the DddA half$^{A}$ may be physically arranged so that it approaches the deamination site (e.g., for reconstitution) from any side (e.g., same side, top, opposite side, bottom, or any other angle to the deamination site (e.g., off-axis)) such that it may reconstitute with its DddA half$^{B}$. Additionally, while the figure shows the mitoTALEA and mitoTALEB binding to target sites on opposite sides of the deamination site, it can be readily envisioned that in view of the aforementioned description regarding orientation, that the two mitoTALE (e.g., A and B) may bind on the same side of the deamination site or opposite sides, provided that the DddA halves may reconstitute and effect deamination at the deamination site. Moreover, while the figure shows the mitoTALEA and mitoTALEB binding to target sites on opposite strands of the DNA duplex, it can be readily envisioned that in view of the aforementioned description regarding orientation, that the two mitoTALE (e.g., A and B) may bind on the same strand of the DNA duplex or opposite strands, provided that the DddA halves may reconstitute and effect deamination at the deamination site. Using these premises, it can readily be envisioned that in some embodiments, the DddA halves are oriented in any position relative to the deamination site such that they effectuate deamination, and further that the mitoTALE to which they are linked may be on the same side or different side of the deamination site, and in some embodiments, such mitoTALE of each of the DddA halves are on the same side of the deamination site, on different sides of the deamination site, are on the same strand of the DNA duplex, or are on different strands of the DNA duplex.

Figure 1D:
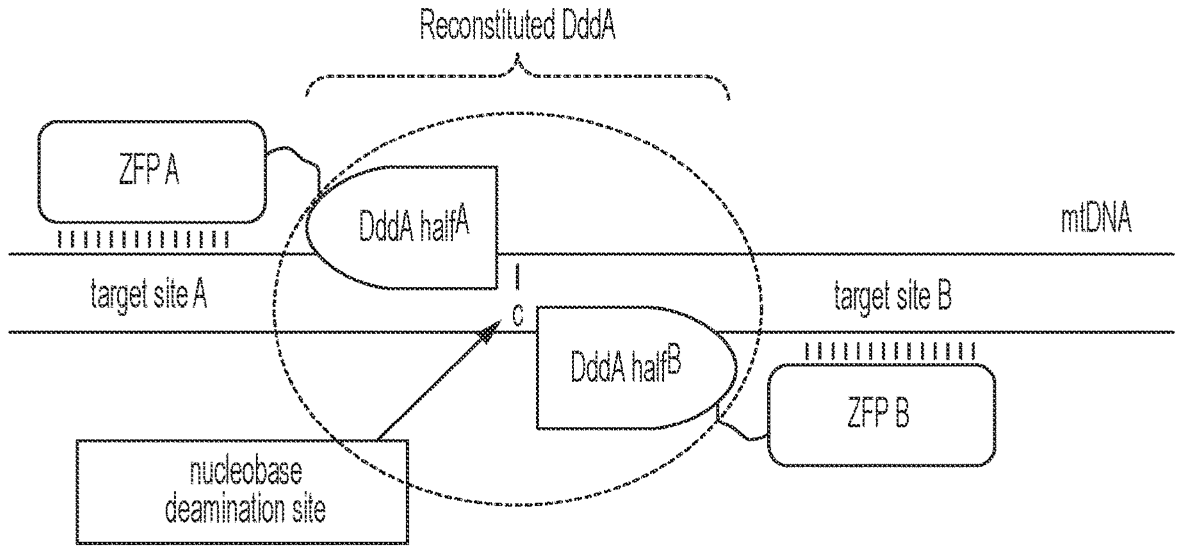

FIG. 1D depicts a pair of mtDNA base editors each comprising a mitoZFP (mitoZFP A and mitoZFP B) fused to an inactive fragment of DddA (DddA half$^A$ and DddA half$^B$). The mitoZFP components bind to their cognate target sites (target site A and target site B) on the mtDNA, thereby localizing the inactive DddA fragments at the target edit/deamination site. Once localized, the DddA activity is restored. It should be noted, that while the ZFPA is shown binding to a target site which is physically arranged on the same side of the deamination site as the DddA half$^A$, the DddA half$^A$ may be physically arranged so that it approaches the deamination site (e.g., for reconstitution) from any side (e.g., same side, top, opposite side, bottom, or any other angle to the deamination site (e.g., off-axis)) such that it may reconstitute with its DddA half. Additionally, while the figure shows the ZFPA and ZFPB binding to target sites on opposite sides of the deamination site, it can be readily envisioned that in view of the aforementioned description regarding orientation, that the two ZFP (e.g., A and B) may bind on the same side of the deamination site or opposite sides, provided that the DddA halves may reconstitute and effect deamination at the deamination site. Moreover, while the figure shows the ZFPA and ZFPB binding to target sites on opposite strands of the DNA duplex, it can be readily envisioned that in view of the aforementioned description regarding orientation, that the two ZFP (e.g., A and B) may bind on the same strand of the DNA duplex or opposite strands, provided that the DddA halves may reconstitute and effect deamination at the deamination site. Using these premises, it can readily be envisioned that in some embodiments, the DddA halves are oriented in any position relative to the deamination site such that they effectuate deamination, and further that the ZFP to which they are linked may be on the same side or different side of the deamination site, and in some embodiments, such ZFP of each of the DddA halves are on the same side of the deamination site, on different sides of the deamination site, are on the same strand of the DNA duplex, or are on different strands of the DNA duplex.

Figure 1E:
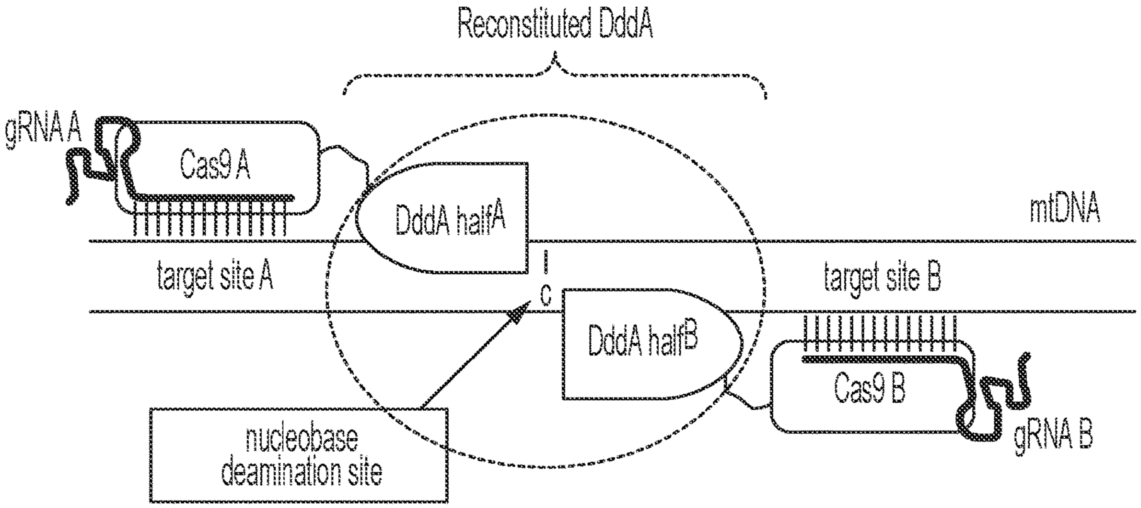

FIG. 1E depicts a pair of mtDNA base editors each comprising a Cas9 (Cas9 A and Cas9 B) fused to an inactive fragment of DddA (DddA half$^A$ and DddA half$^B$). The Cas9 components bind to their cognate target sites (target site A and target site B) on the mtDNA as programmed by their respective guide RNAs, thereby localizing the inactive DddA fragments at the target edit/deamination site. Once localized, the DddA activity is restored. It should be noted, that while the Cas9A is shown binding to a target site which is physically arranged on the same side of the deamination site as the DddA half$^A$, the DddA half$^A$ may be physically arranged so that it approaches the deamination site (e.g., for reconstitution) from any side (e.g., same side, top, opposite side, bottom, or any other angle to the deamination site (e.g., off-axis)) such that it may reconstitute with its DddA half$^B$. Additionally, while the figure shows the Cas9A and Cas9B binding to target sites on opposite sides of the deamination site, it can be readily envisioned that in view of the aforementioned description regarding orientation, that the two Cas9 (e.g., A and B) may bind on the same side of the deamination site or opposite sides, provided that the DddA halves may reconstitute and effect deamination at the deamination site. Moreover, while the figure shows the Cas9A and Cas9B binding to target sites on opposite strands of the DNA duplex, it can be readily envisioned that in view of the aforementioned description regarding orientation, that the two Cas9 (e.g., A and B) may bind on the same strand of the DNA duplex or opposite strands, provided that the DddA halves may reconstitute and effect deamination at the deamination site. Using these premises, it can readily be envisioned that in some embodiments, the DddA halves are oriented in any position relative to the deamination site such that they effectuate deamination, and further that the Cas9 to which they are linked may be on the same side or different side of the deamination site, and in some embodiments, such Cas9 of each of the DddA halves are on the same side of the deamination site, on different sides of the deamination site, are on the same strand of the DNA duplex, or are on different strands of the DNA duplex.

Figure 1F:
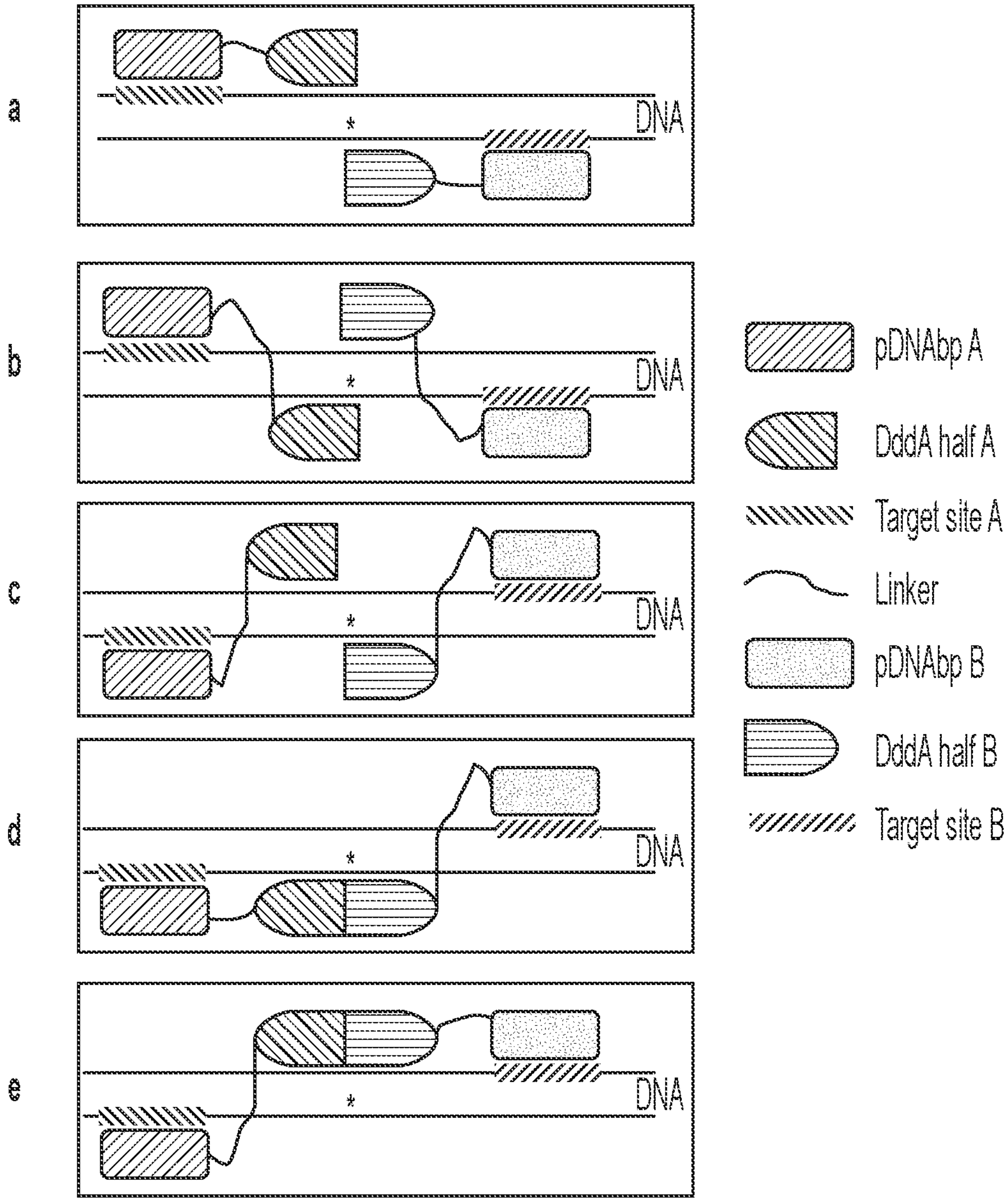
Figure 1F:
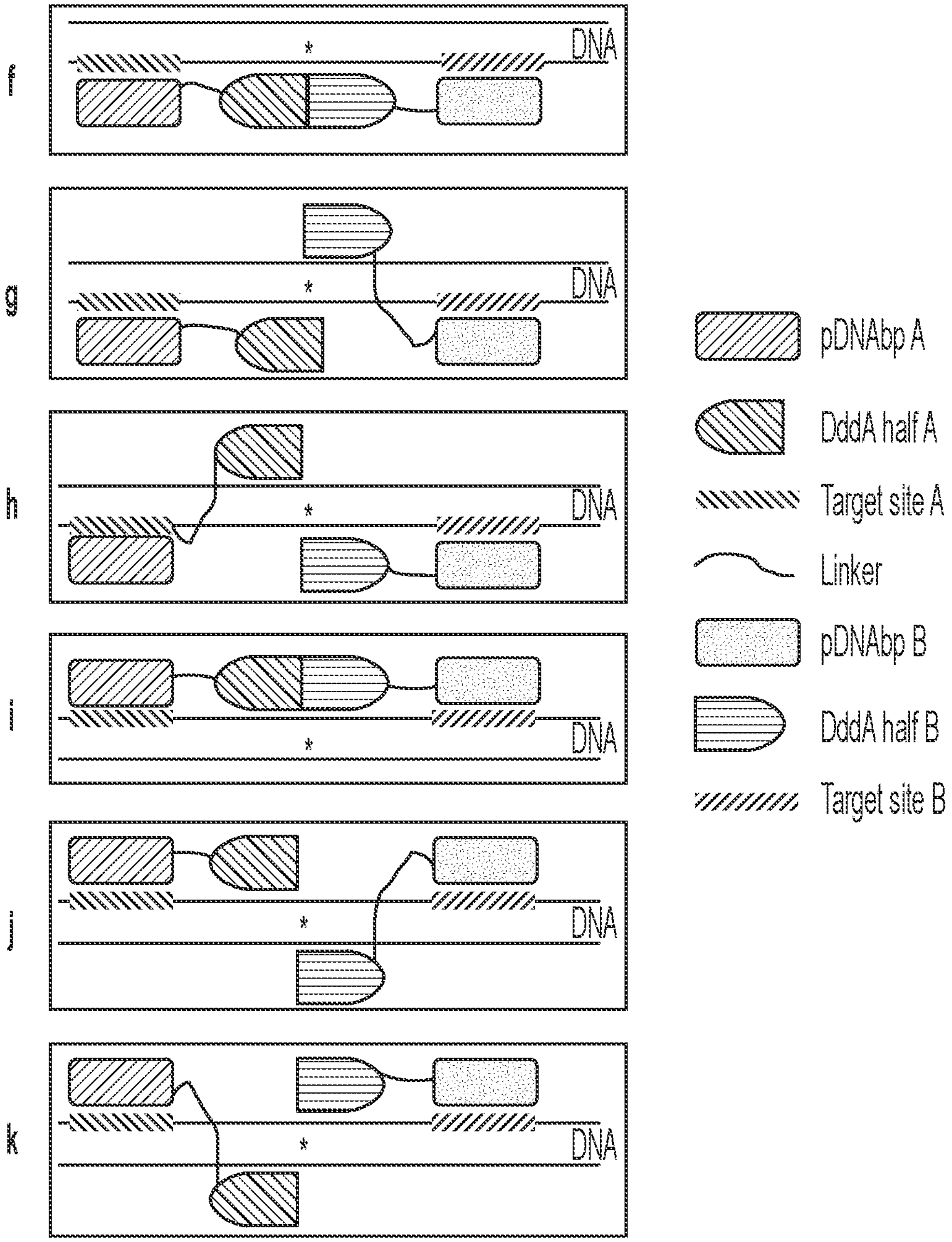
Figure 1F:
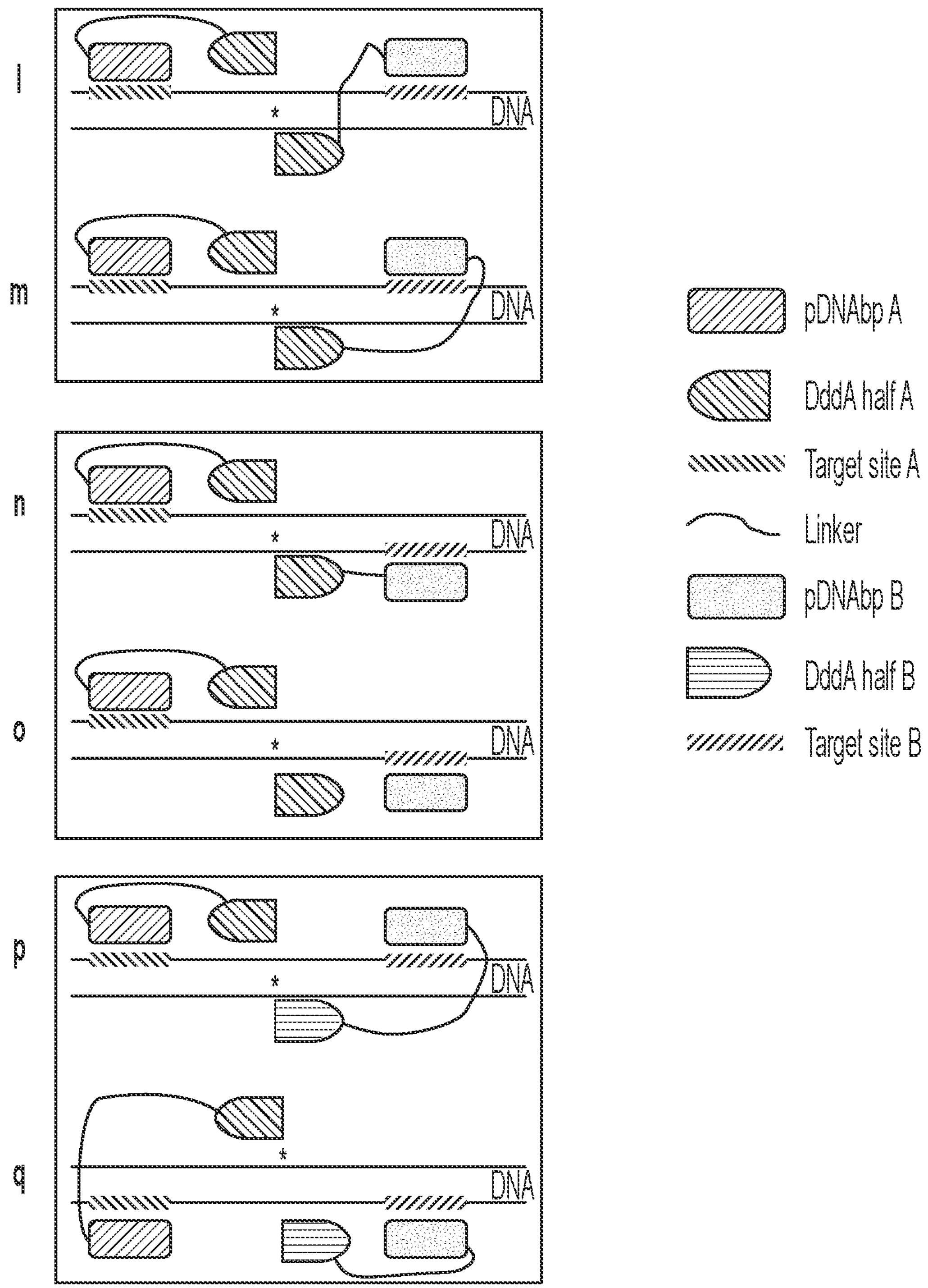
Figure 1F:
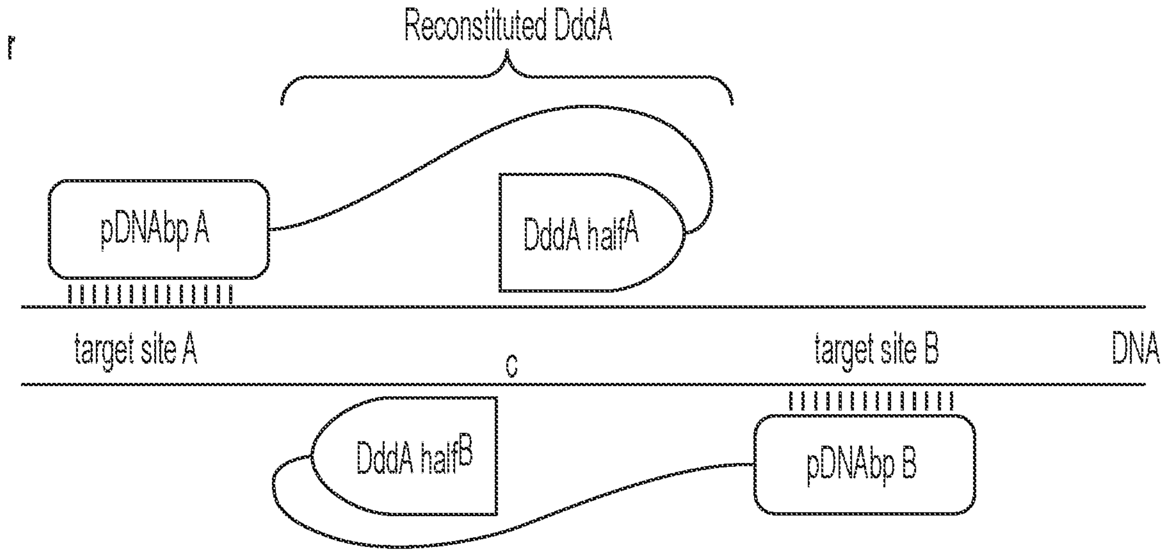

FIG. 1F. depicts a variety of architectural embodiments envisioned for the constructs described in any of FIGS. 1A to 1E. These architectural embodiments are not intended to limit the present disclosure as other architectures are also feasible and are contemplated by this disclosure. Embodiment (a) depicts a first fusion protein comprising a pDNAbp (arbitrarily labeled pDNAbp A) fused to a DddA half domain (arbitrarily labeled DddA half A) which binds to a first target site on a strand of a double-stranded DNA molecule (e.g., a miDNA). The first target site is arbitrarily labeled "target site A." This embodiment also depicts a second fusion protein comprising a second pDNAbp (i.e., pDNAbp B) fused through a linker to a second DddA half (i.e., DddA half B). The second fusion protein is shown binding to a second target site on the opposite strand of DNA as the first target site. The DddA half A and DddA half B associate at the deamination site ("*") to form a functional DddA which then proceeds to deaminate the deamination site. As illustrated by architectural embodiments in (a) through (e), the target sites are located on opposite strands of the DNA, with the pDNAbps binding to opposite strands. Embodiments (f) through (k), however, show that the target sites may be located on the same strand, with the pDNAbps binding to the same strands. In some embodiments, such as in (f) through (i), the target sites to which the pDNAbps bind are located on the same strand containing the target deamination site ("*"). In other embodiments, as depicted in (i) through (k), the target sites to which the pDNAbps bind are located on the strand opposite the strand containing the target deamination site ("*"). In addition, the fusion proteins can be arranged in any suitable linear order of domains, including N-[dDNAbp]-[linker]-[DddA half]-C and N-[DddA half]-[linker]-[dDNAbp]-C. Still further, the fusion proteins may be configured such that the DddA halves (e.g., DddA half A and DddA half B) associate near or adjacent the deamination target site, such as in same-side association near the deamination site in (d) or (f), or opposite-side association opposite the deamination site in (e) and (i), or combinations of these configurations, as in (a), (b), (c), (g), (h), (j), (k), or (l) through (q). In addition, the linker may fuse the DddA domain to either side of the pDNAbp, as shown in the variations of (l) through (q), or combinations of these embodiments. In addition, the DddA halves may associate with one another on either side of the target deamination site (e.g., compare embodiment (r) versus any of the embodiments of (a) through (q). The disclosure is not limited to the embodiments depicted.

Figure 2A:
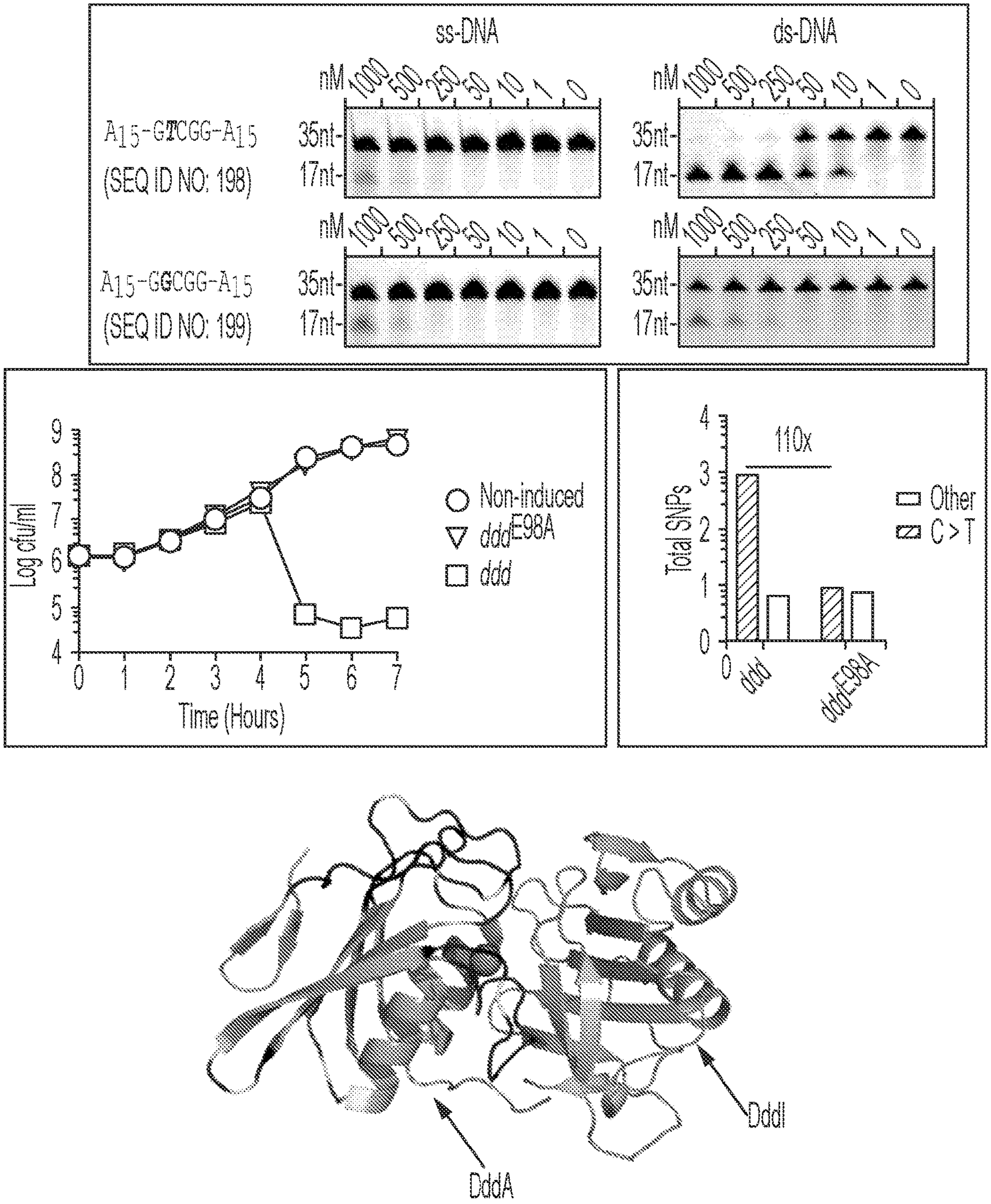

FIGS. 2A-2B show DddA toxin is a double-stranded DNA cytidine deaminase toxin. FIG. 2A: Top, In vitro cytidine deamination assay using single-stranded DNA (left) or double-stranded (right) 6-carboxyfluorescein-labelled DNA substrate. DddA has a stronger preference for deaminating cytidines in the 5'-TC context compared to cytidines in the 5'-GC context. Middle, Viability of *E. coli* populations expressing active DddA (ddd), catalytically inactive DddA (dddE98A), induced after 4 h. Viability of DddA-expressing *E. coli* decreases drastically while the viability of populations containing inactive DddA remain comparable to the non-induced control. Number of SNPs from the indicated nucleotide classifications observed in *E. coli* following intoxication with DddA or inactive DddA. DddA-expressing *E. coli* contains >100-fold C•G-to-T•A transitions compared to strains expressing inactive DddA. Bottom. Co-crystal structure of DddA bound to immunity protein DddI. FIG. 2B: Differences between a ssDNA cytidine deaminase editor and a hypothetical dsDNA cytidine deaminase base editor. The previously published rAPOBEC1-Cas9 nickase-UGI fusion is an example of a ssDNA cytidine deaminase. DddA-derived cytosine base editor (DdCBE) is an example of a dsDNA cytidine deaminase editor FIG. 3. shows screening for split sites in DddA to overcome the toxicity of full-length DddA. DddA was split at 12 different sites as listed in the table. For each split, the N-terminal (DddA-N) and C-terminal (DddA-C) halves were each fused to a dCas9-2xUGI protein to form DddA-N-dCas9-2xUGI and DddA-C-dCas9-2xUGI, respectively. Both halves were plasmid transfected into HEK293T cells. Genomic DNA was harvested after 3 days for high-throughput DNA sequencing. Active split-DddA fusions were identified based on the percentage of C•G-to-T•A conversion at target cytidines within the spacing region flanked by the two dCas9 proteins.

Figure 4:
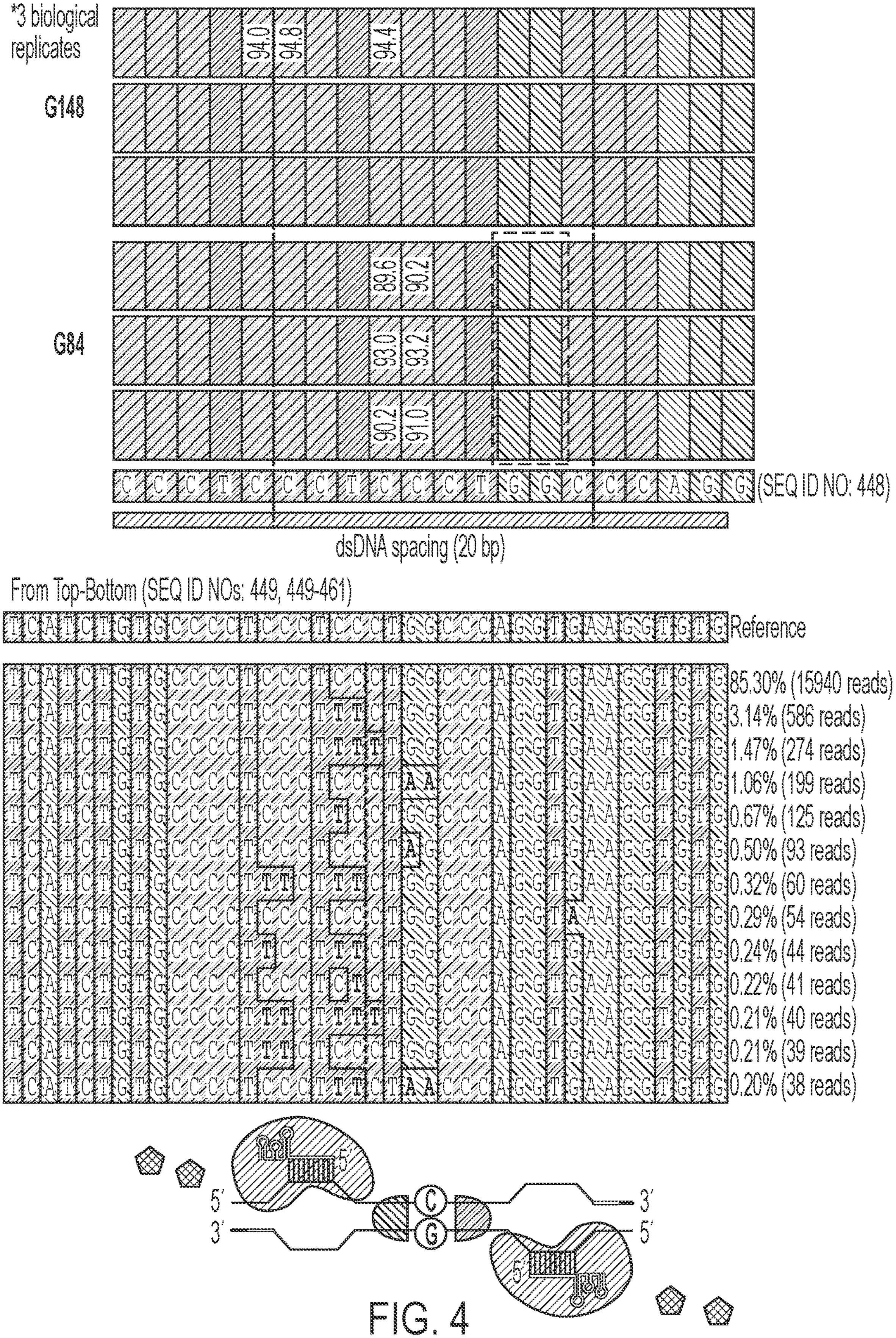

FIG. 4 shows splitting DddA at G148 and G84 resulted in two inactive halves that reconstitute activity when co-localized on DNA in HEK293T cells. Nucleotide percentage summary plots showing the percentage of nucleotides at each position of the target spacing region. The appearance of "*" within the C-containing positions indicate C-to-T conversion while the appearance of "^" within the G-containing positions indicate G-to-A conversion.

Figure 5:
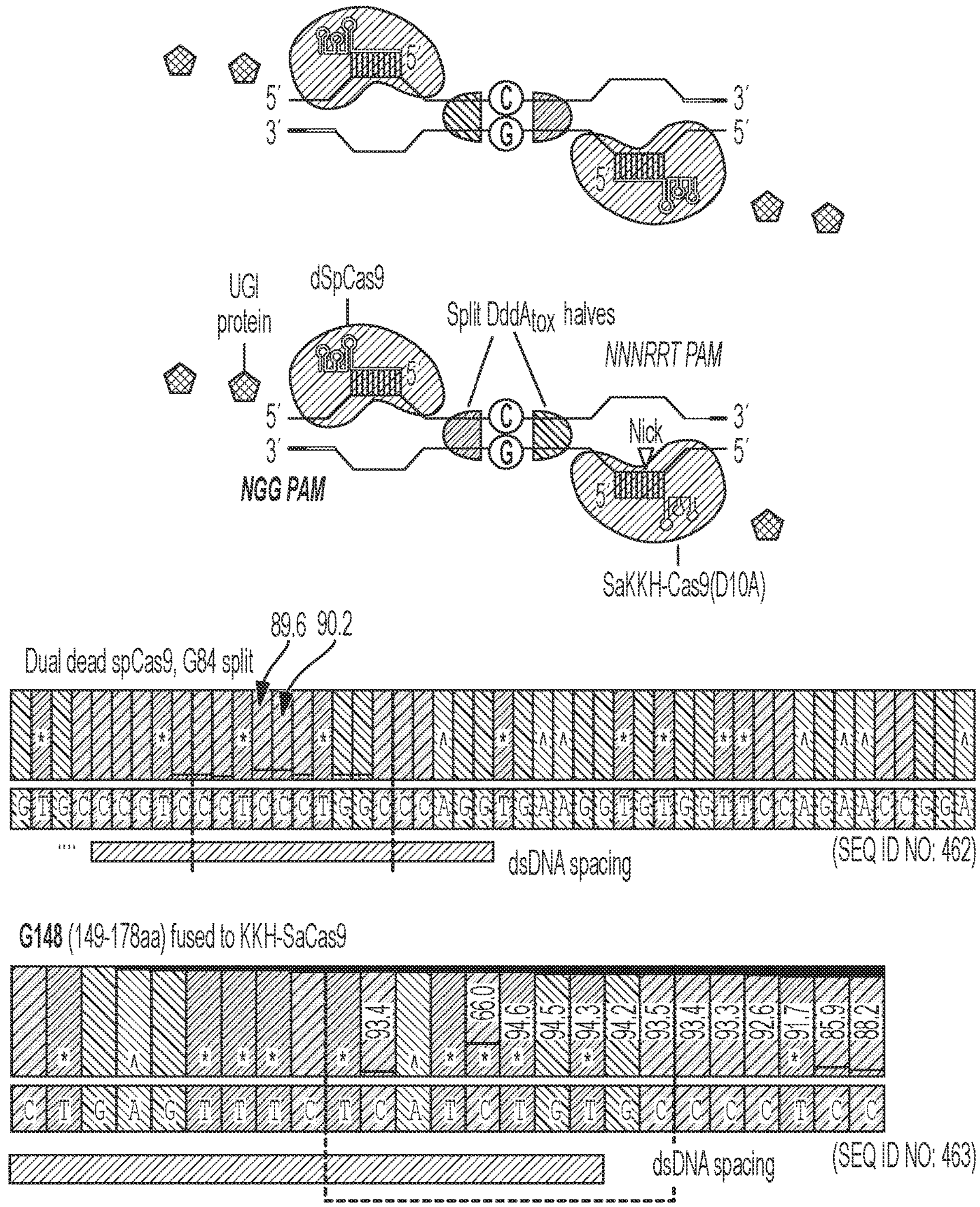

FIG. 5 shows inactive DddA-N and DddA-C halves fused to orthogonal Cas9 proteins reassemble into an active cytidine deaminase. The initial screen was performed with two identical dCas9 proteins, thus precluding control of DddA fusion orientation. In this screen, two fusion orientations are possible for a given DddA split. The aureus-N orientation comprises of DddA-C-dCas9-2xUGI and DddA-N-SaKKH-Cas9(D10A)-1xUGI. The aureus-C orientation comprises of DddA-N-dCas9-2xUGI and DddA-C-SaKKH-Cas9(D10A)-1xUGI. The nucleotide percentage summary plots shows C•G-to-T•A conversion for the G148 split in the DddA-N-dCas9-2xUGI and DddA-C-SaKKH-Cas9(D10A)-1xUGI orientation.

Figure 6:
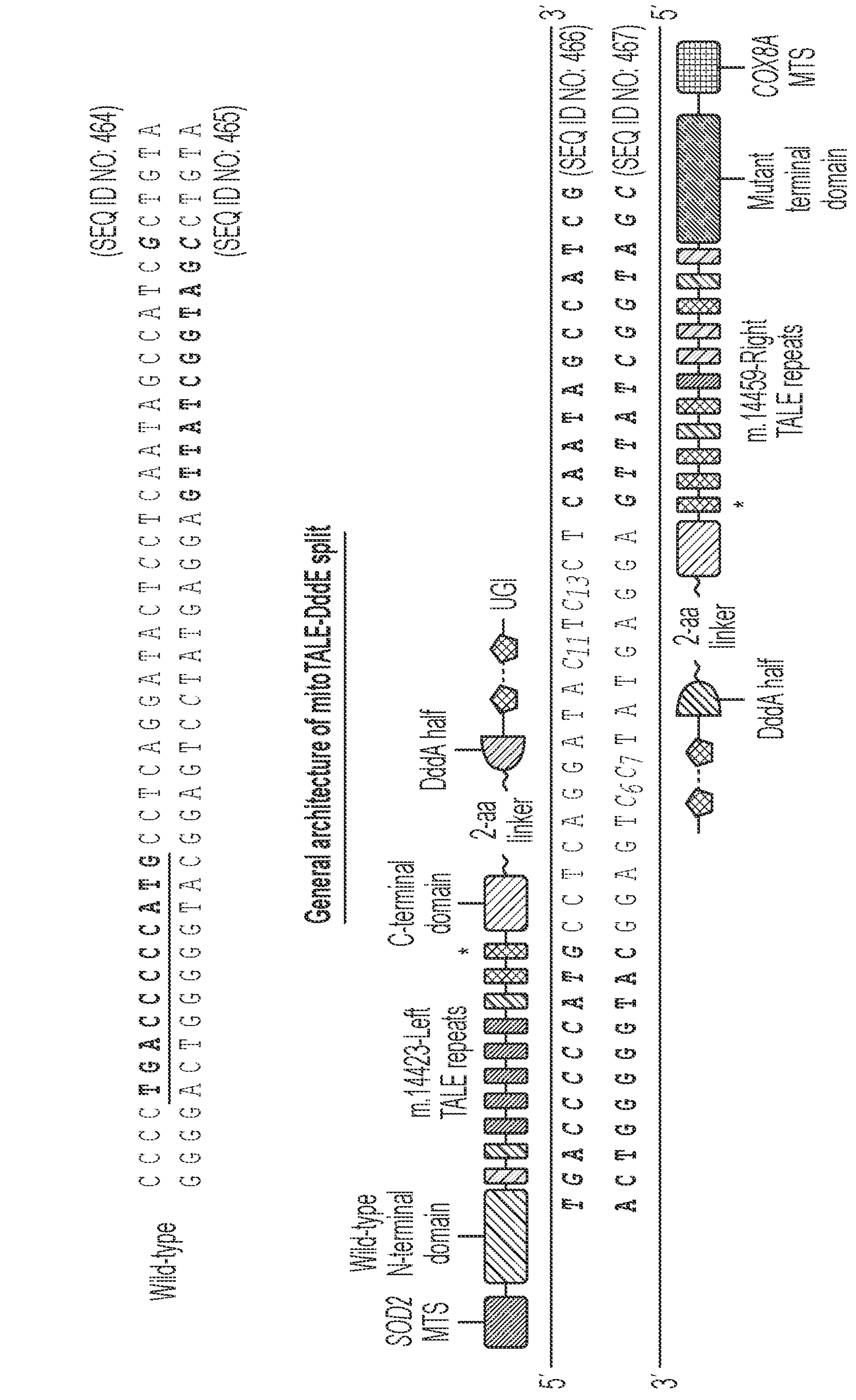

FIG. 6 shows the architecture of DdCBE. DdCBE comprises of a left monomer and right monomer. The architecture of each monomer of a mitoTALE-split-DddAtox pair (in N- to C-terminus order): an MTS, a TALE array, a 2-amino acid linker, a DddAtox half from the G1333 or G1397 split, and one or two UGI proteins. Final optimization studies indicate higher editing efficiencies with one copy of UGI protein. The TALE proteins of the indicated DdCBE binds to the human MT-ND6 gene.

Figure 7:
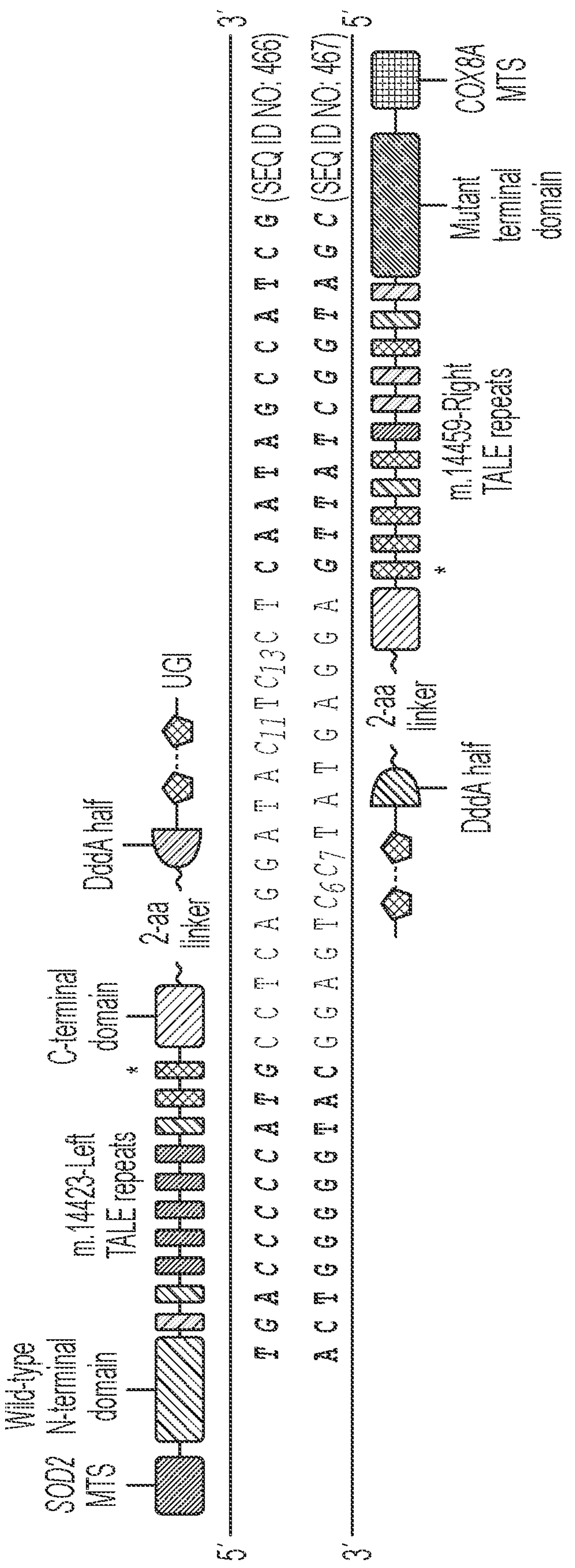

FIG. 7 shows the architecture of DdCBE. DdCBE comprises of a left monomer and right monomer. The architecture of each monomer of a mitoTALE-split-$DddA_{tox}$ pair (in N- to C-terminus order): an MTS, a TALE array, a 2-amino acid linker, a $DddA_{tox}$ half from the G1333 or G1397 split, and one or two UGI proteins. Final optimization studies indicate higher editing efficiencies with one copy of UGI protein. The TALE proteins of the indicated DdCBE binds to the human MT-ND6 gene.

Figure 8A:
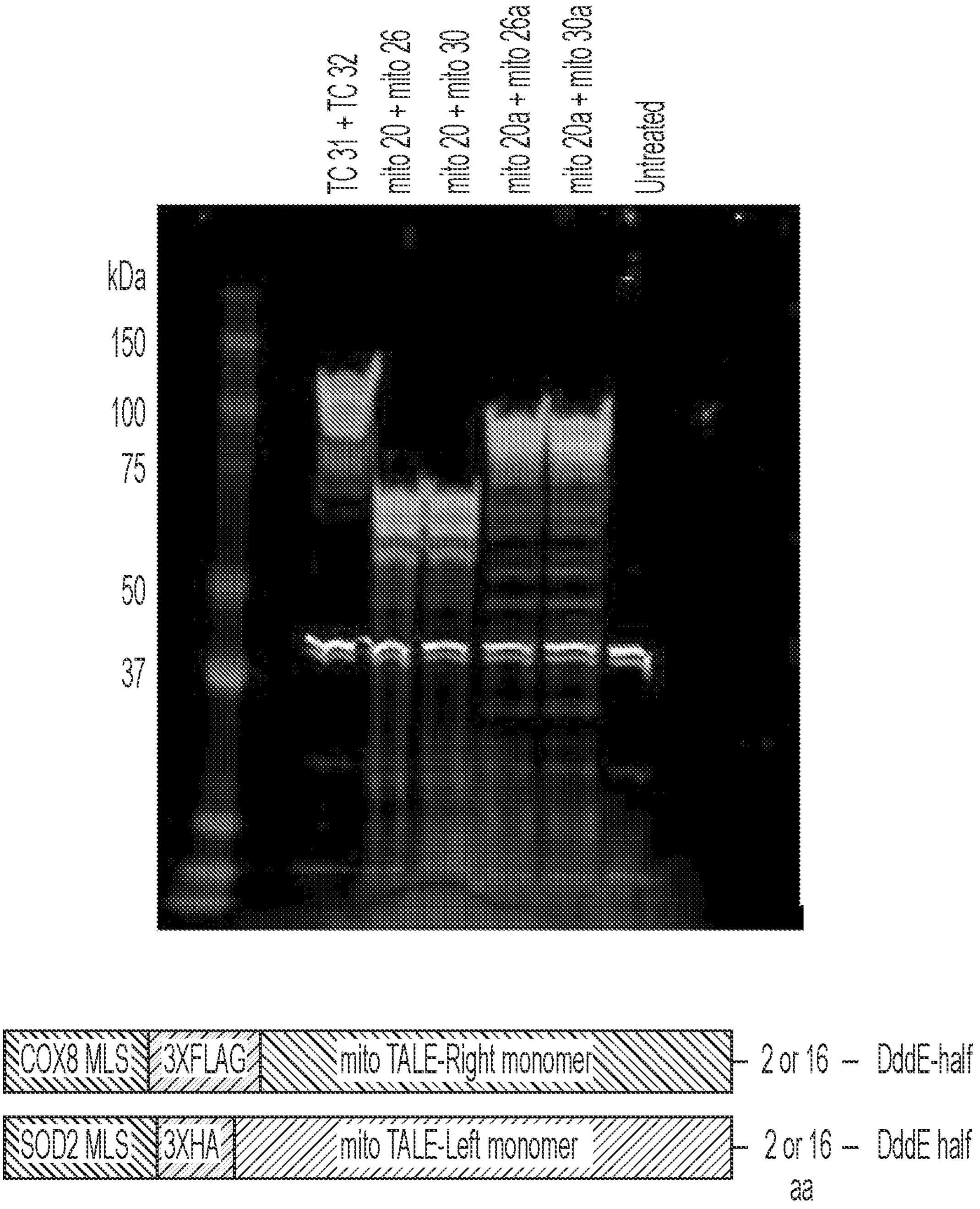

FIGS. 8A-8B show TALE-DddA constructs. FIG. 8A shows 2x-UGI TALE-split DddA and UGI-free TALE-split halves expresses well in HEK293T cells i. TC31 and TC32 are FokI-based TALENs that target nuclear CCR5 and were included as positive controls. Mito20: SOD2 MTS-3xHA-left TALE m.14459A TALE-2aa¬-G1333 DddA-N; Mito20a: SOD2 MTS-3xHA-2xUGI-left TALE m.14459A TALE-2aa¬-G1333 DddA-N; mito26: COX8a MTS-3xFLAG-right TALE m.14459A TALE(Nt-αN)-2aa-G1333 DddA-C; mito26a: COX8a MTS-3xFLAG-2xUGI-right TALE m.14459A TALE(Nt-αN)-2aa-G1333 DddA-C; mito30: COX8a MTS-3xFLAG-right TALE m.14459A TALE(Nt-βN)-2aa-G1333 DddA-C: mito30a: COX8a MTS-3xFLAG-2xUGI-right TALE m.I4459A TALE(Nt-βN)-2aa-G1333 DddA-C. FIG. 8B shows the architectures of TALE,-DddA constructs listed in FIG. 8A.

Figure 9A:
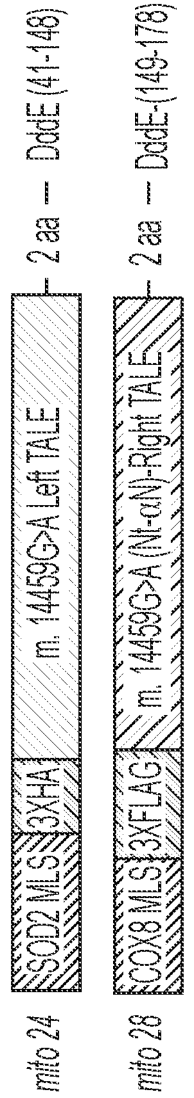
Figure 9B:
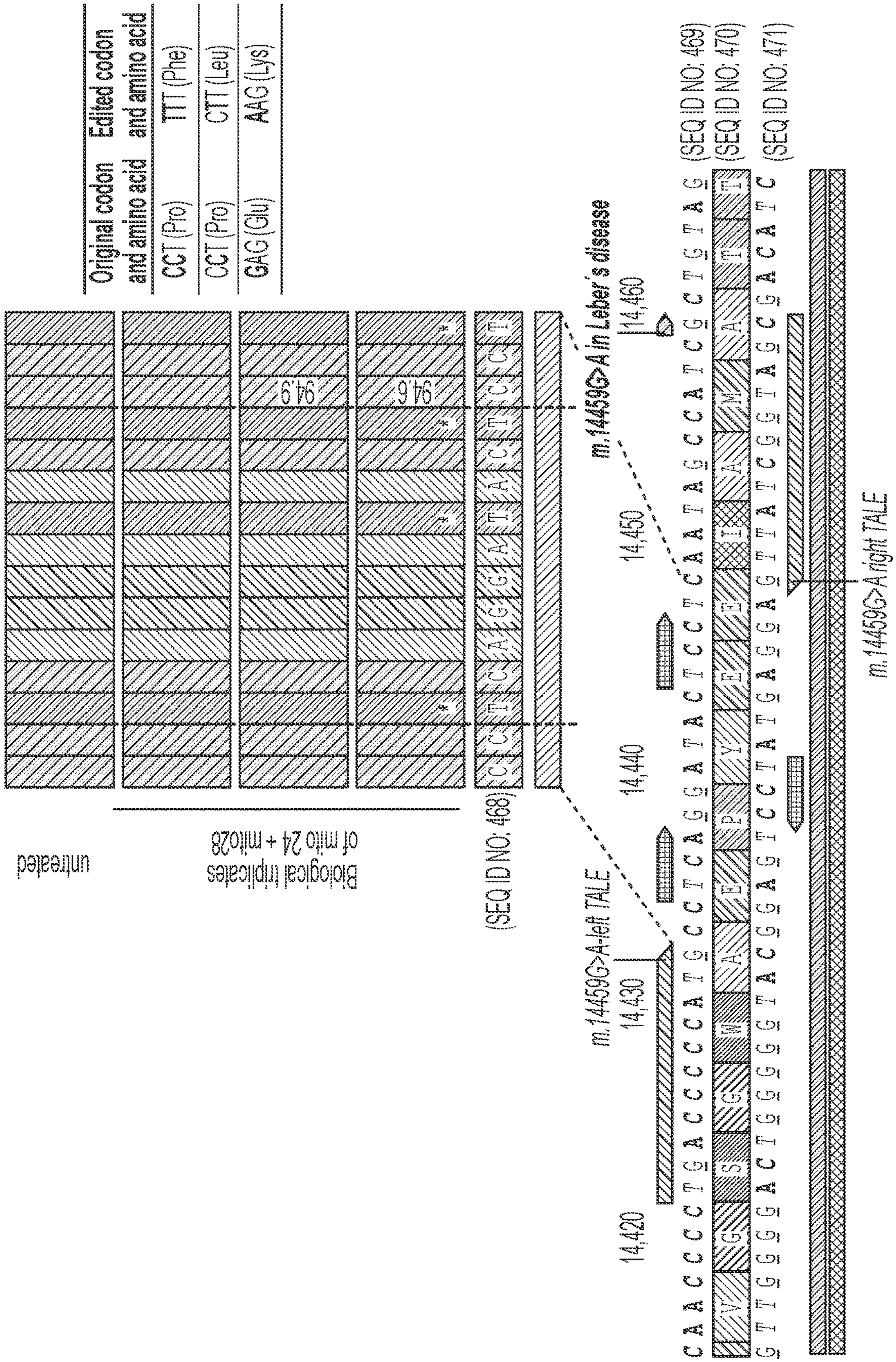

FIGS. 9A-9B show TALE-G1397 split DddA fusions. FIG. 9A shows the architectures of TALE-G1397 split DddA fusions. DddA was split at G1397. The N-terminus half was fused to the left TALE, and the C-terminus half is fused to the Right TALE. TALE sequences target the human MT-ND6 gene. The N-terminal domain of the right TALE is modified (Nt-αN) to recognize non-T nucleotides at the 5' position immediately after the first nucleotide of the TALE binding sequence. FIG. 9B shows TALE-G1397 split DddA fusions edits the MT-ND6 gene. Genomic context MT-ND6. TALE binding sites are annotated in lime green. Nucleotide percentage summaries of each positions within the target spacing region is shown. C-to-T conversion is shown by the appearance of "*".

Figure 10:
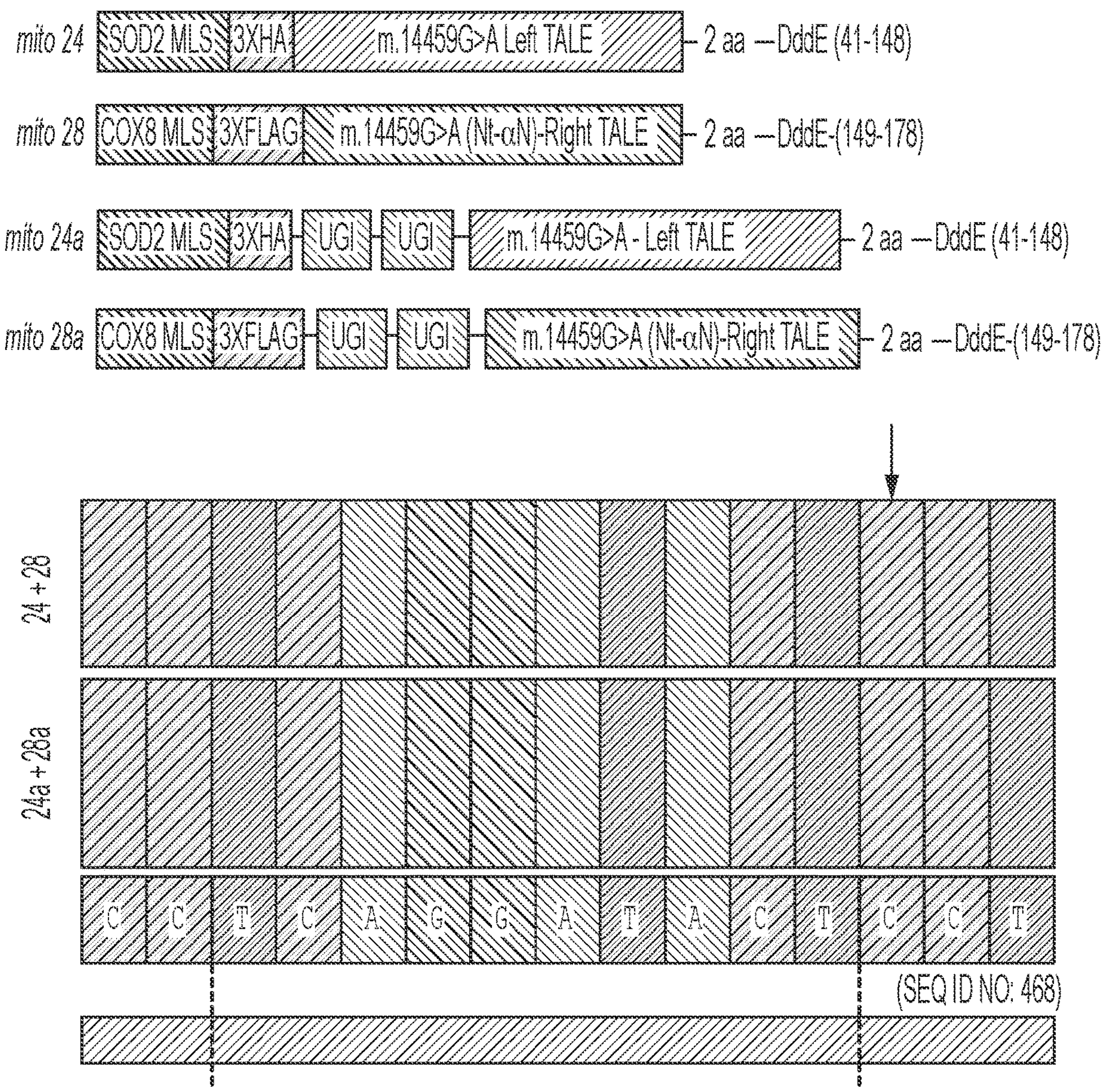

FIG. 10 shows N-terminal UGI fusions abrogate editing activity. Mito 24a and Mito 28a each contains 2 copies of UGI protein fused to the N-terminus of the TALE-split DddA fusion. Nucleotide percentage summaries of HEK193T cells treated with Mito 24a and Mito 28a show the absence of editing at the target C (arrow).

Figure 11:
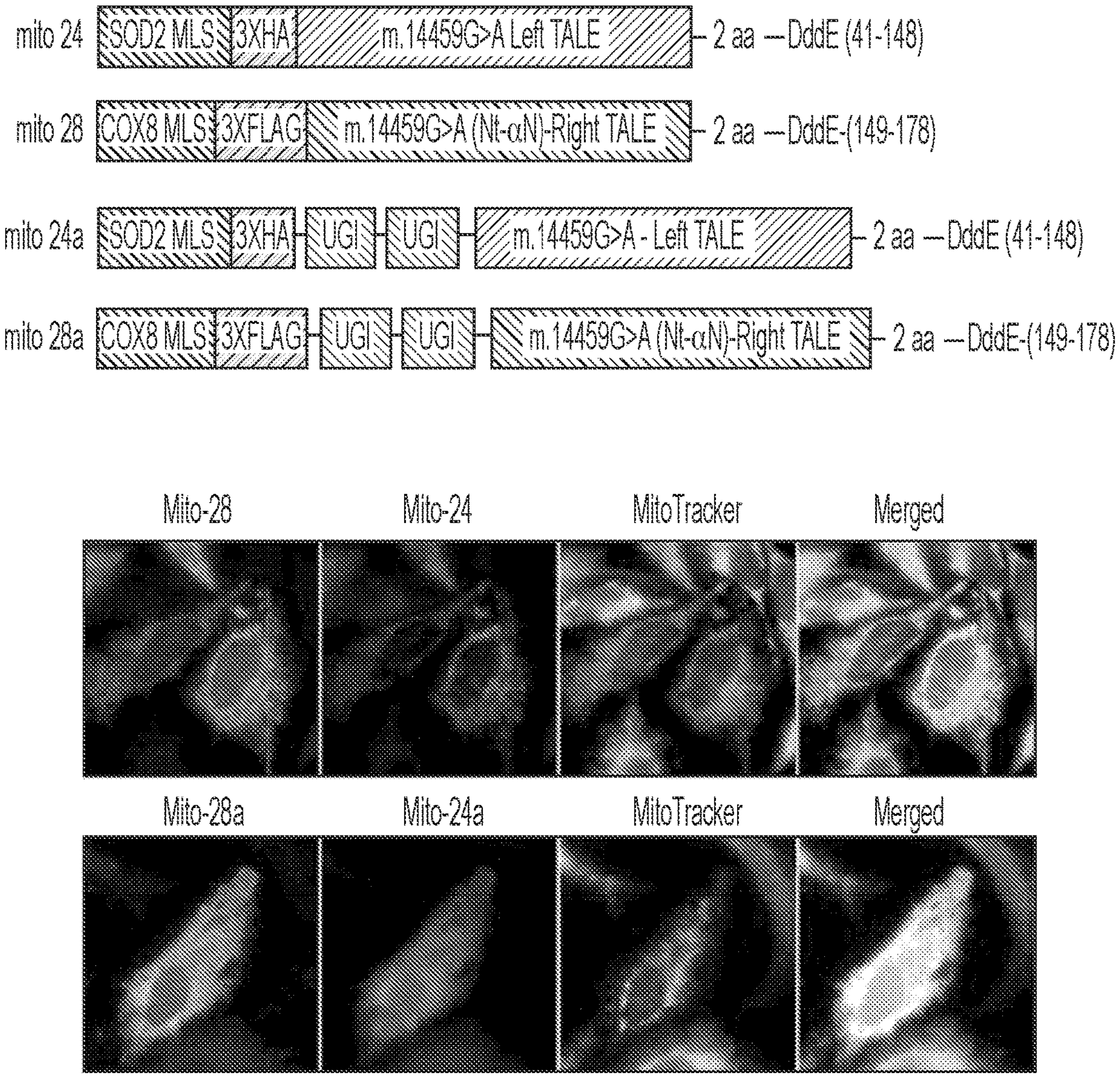

FIG. 11 shows N-terminal UGI fusions do not localize into the mitochondria. Fluorescence imaging of HA- and FLAG-tagged halves of mitoTALE-DddAtox and UGI-mitoTALE-DddAtox-UGI pairs in HeLa cells 24 h after plasmid transfection. Mitochondrial localization was followed using Mitotracker. Non-UGI containing fusions (mito 24 and mito 28) localized to the mitochondria while N-terminal UGI fusions (mito 24a and mito 28a) remain diffused throughout the cytoplasm.

Figure 12B:
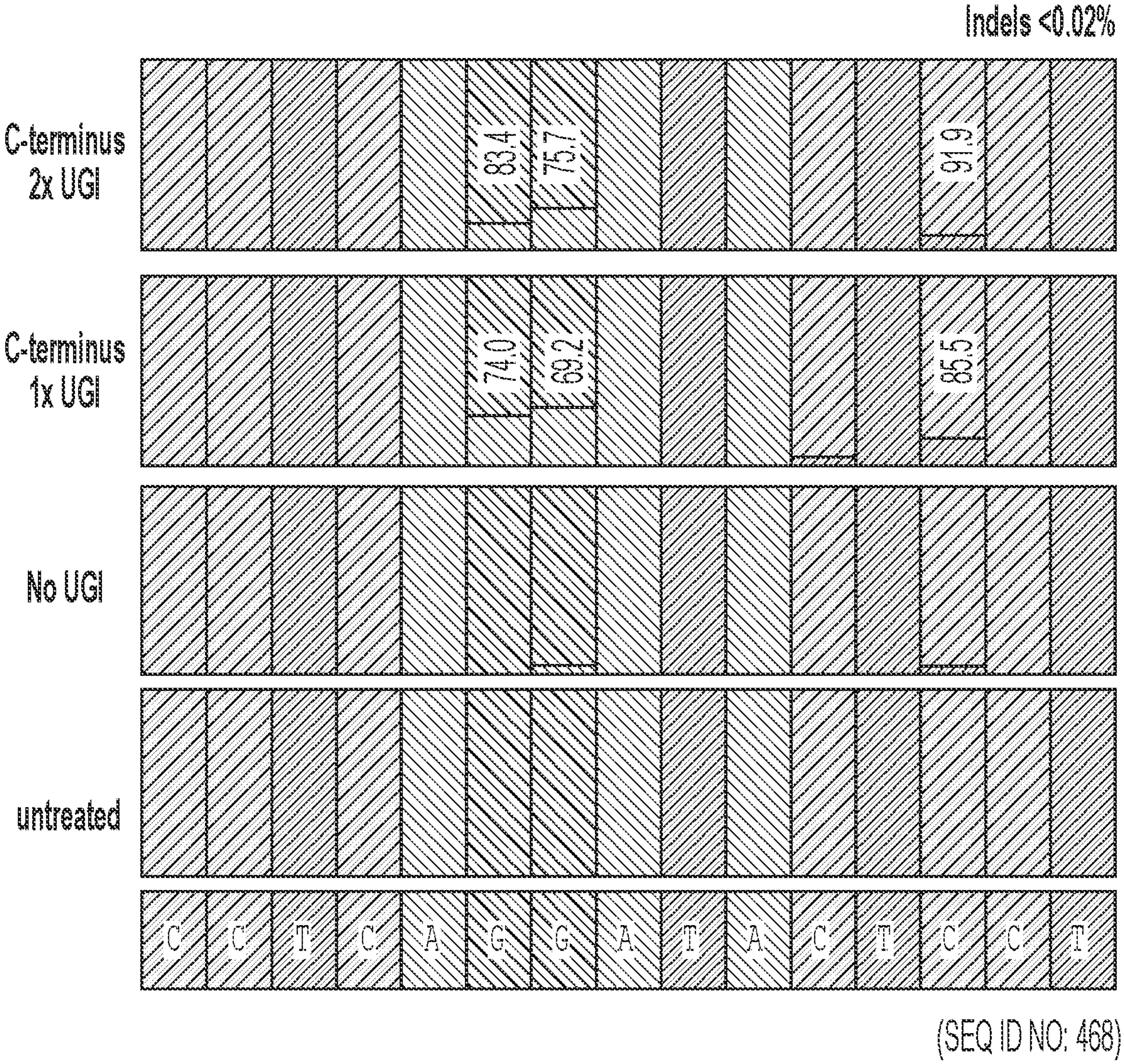

FIGS. 12A-12B show adding UGI to the C-terminus of mitoTALE-DddA fusions improves editing efficiencies. FIG. 12A: ND6 editing efficiencies from fusions containing 1x- or 2x-UGI proteins at the N- or C-terminus 3 days post-transfection are shown. Refer to FIG. 13 for the architectures of each construct. Schematic representation of the mitoTALE-split DddA fusions is shown. FIG. 12B: Nucleotide percentage summaries at MT-ND6. Fusions containing one copy of UGI protein (C-terminus 1xUGI) results in a slightly higher editing that fusions containing two copies of UGI protein (C-terminus 2xUGI).

FIG. 13 is a summary of architecture, editing efficiency and mitochondria localization of the respective constructs listed in FIG. 12A. N.D., not detectable.

Figure 14:
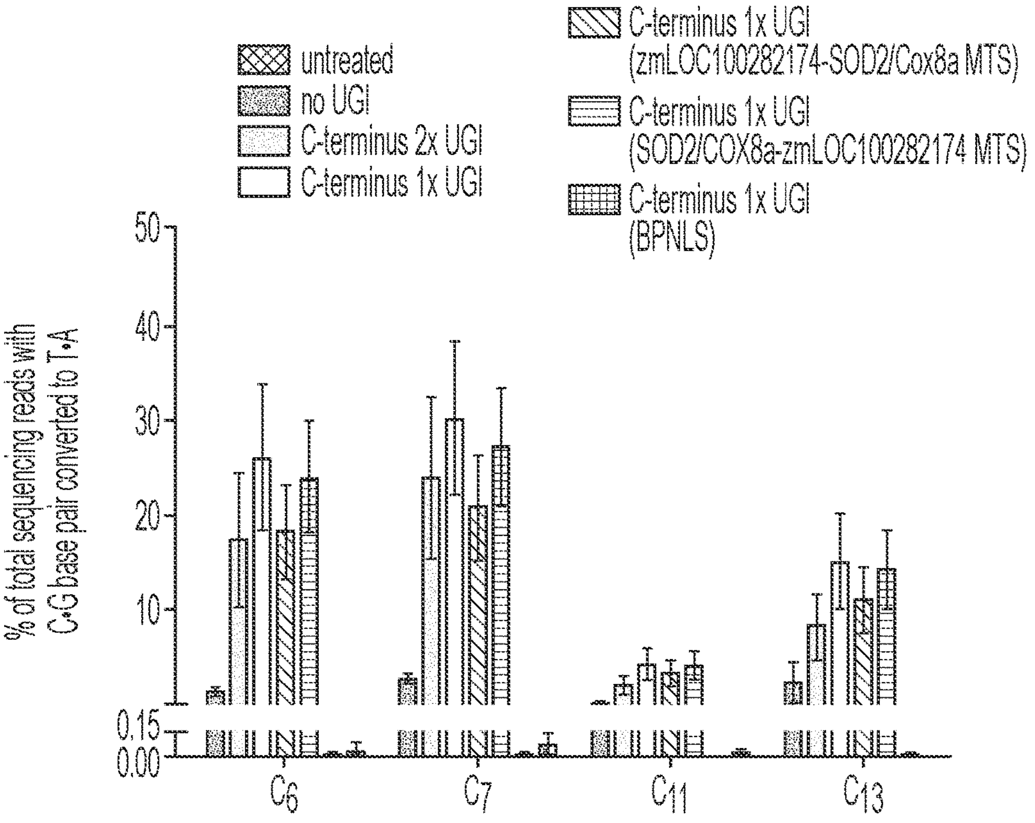

FIG. 14 shows alternative mitochondria targeting signal (MTS) sequences do not boost editing efficiency. The original MTS sequences used were COX8a and SOD2 MTS. Tandem fusions of a maize-derived MTS (zm-LOC100282174) to COX8a and SOD2 do not improve editing significantly. BPNLS, bipartite nuclear localization signal.

Figure 15:
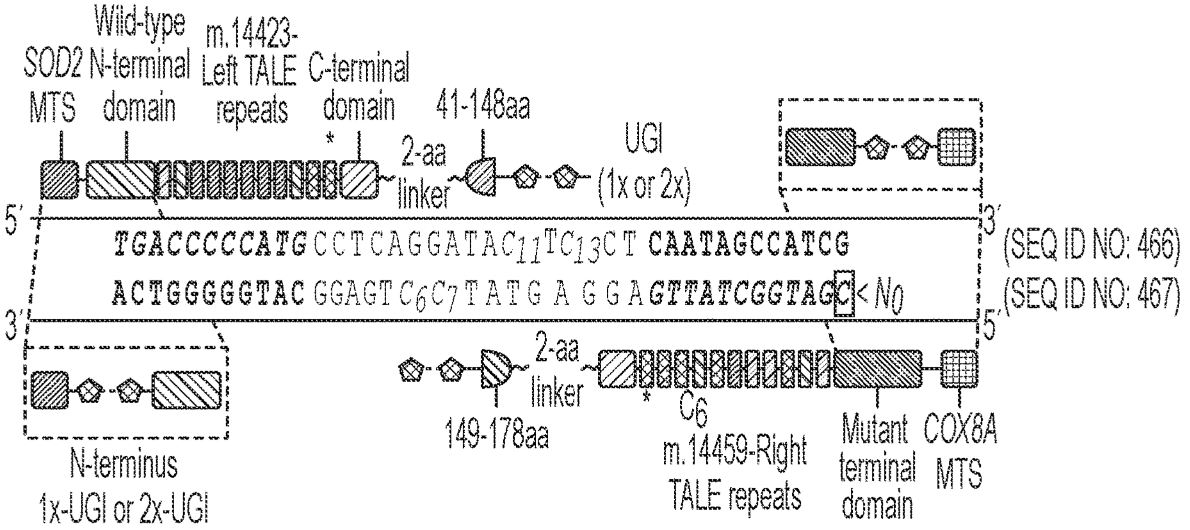

FIG. 15 is a schematic representation of mitoTALE-split DddA fusion.

Figure 17:
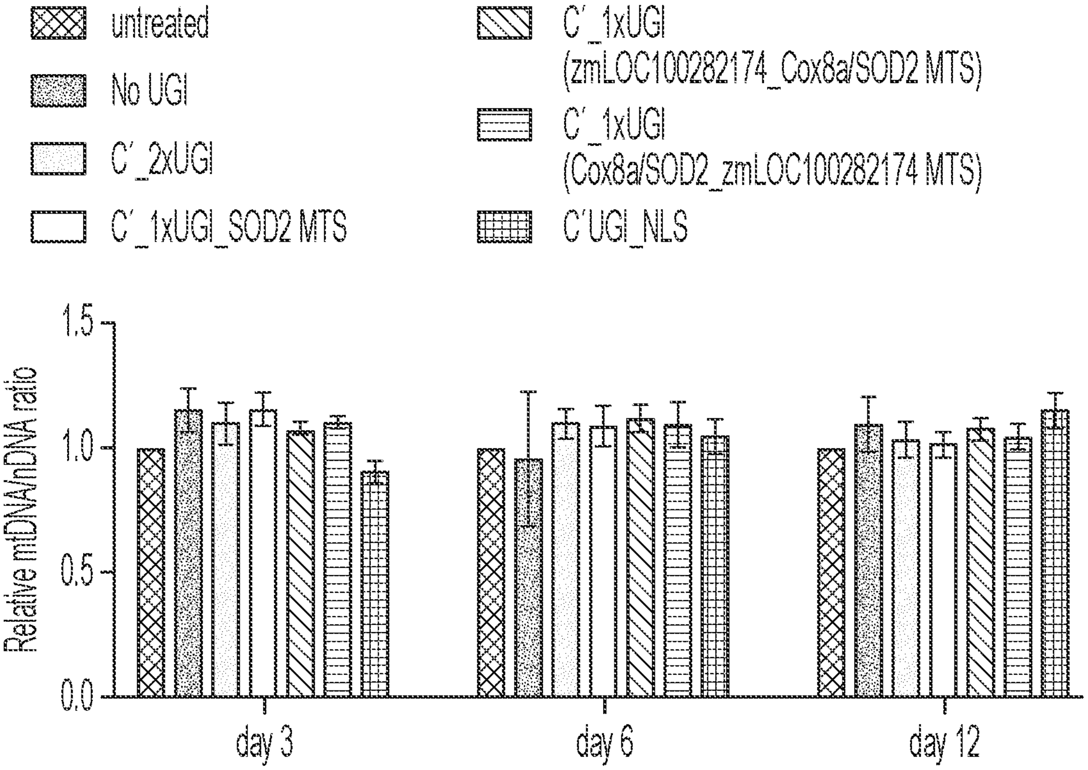

FIG. 16 Shows DdCBE editing increases with duration of base editor treatment. MT-ND6 editing efficiencies of HEK293T are shown for the listed constructs. Cells were harvested 3-days or 6-days post-transfection C'-2xUGI and C'-1xUGI are mitoTALE-split DddA fusions that contain 2 copies or 1 copy of UGI appended to the C-terminus, respectively. BPNLS, bipartite nuclear localization signal FIG. 17 shows DdCBE-edited cells maintain mtDNA copy numbers. mtDNA levels of MT-ND6-edited cells were measured by quantitative PCR relative to untreated cells. Cells that were treated with listed variants of base editors had similar relative mtDNA levels to edited cells, suggesting that DdCBE editing does not impact mtDNA integrity.

Figure 18:
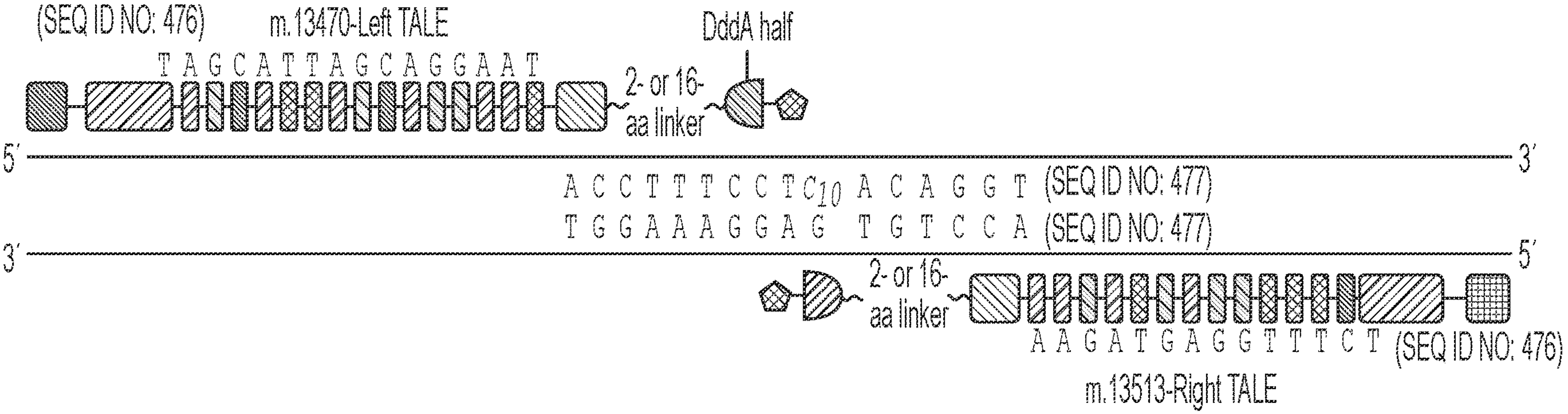

FIG. 18 is a schematic of ND5.1-DdCBE. ND5.1-DdCBE was designed to target the wildtype MT-ND5 gene. TALE binding sites are underlined in red; Possible cytidine substrate are in magenta. The Right-G1397-C+Left-G1397-N orientation selectively target C10 within the target spacing region for editing.

Figure 19:
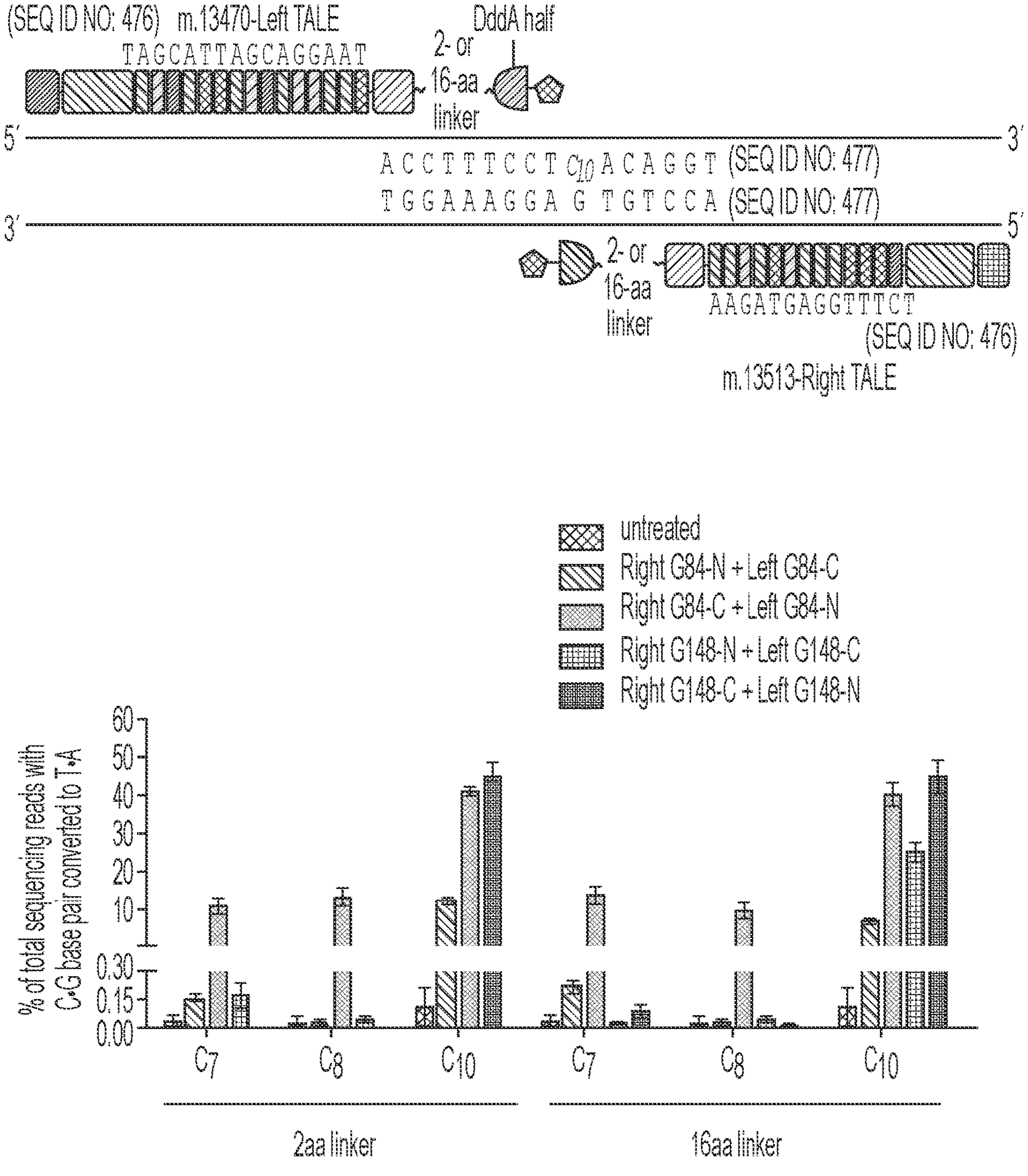

FIG. 19 shows ND5.1-DdCBE edits MT-ND5 efficiently in HEK293T cells. MT-ND5 editing efficiencies are shown for the different DdCBE orientations. mitoTALE-split DddA-UGI fusions containing a 2 amino acid- or 16 amino acid-linker gave similar editing efficiencies.

FIG. 20 shows ND5.1-edited cells maintain mtDNA copy numbers. mtDNA levels of MT-ND6-edited cells were measured by quantitative PCR (qPCR) relative to untreated cells. mtDNA levels were normalized to beta-actin. E, efficiency of qPCR.

Figure 21:
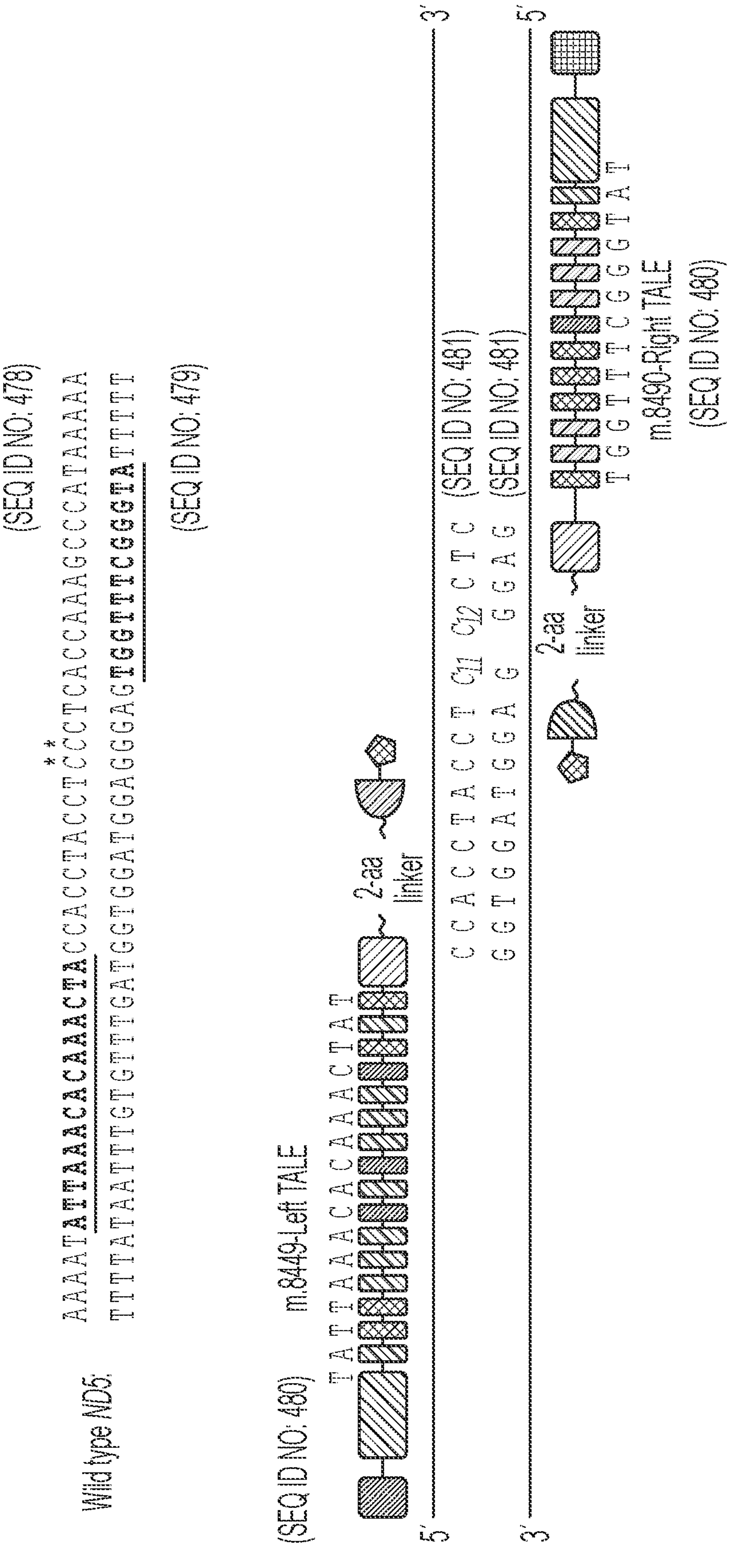

FIG. 21 is a schematic of ND5.2-DdCBE. TALE binding sites are underlined; Possible cytidine substrate are noted by "*". The Right-G1397-N+Left-G1397-C orientation selectively target C11 and C12 within the target spacing region for editing.

Figure 22:
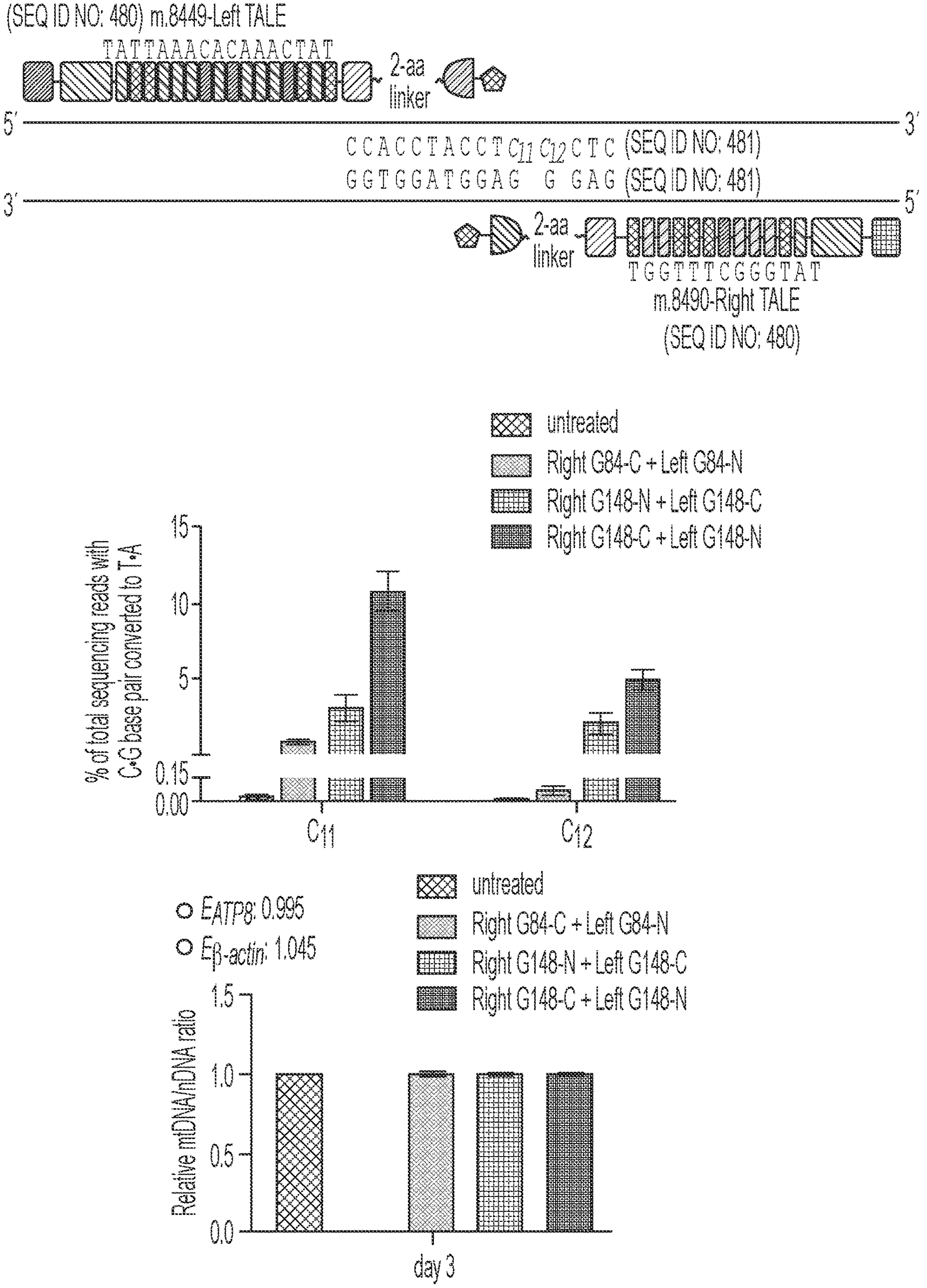
Figure 23A:
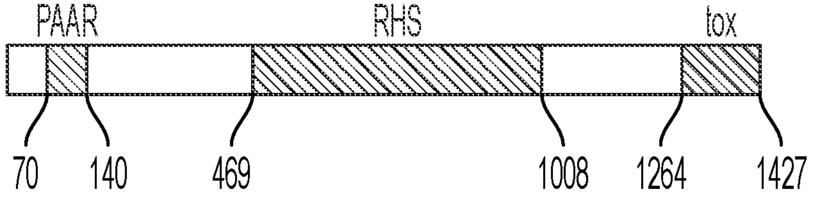
Figure 23B:
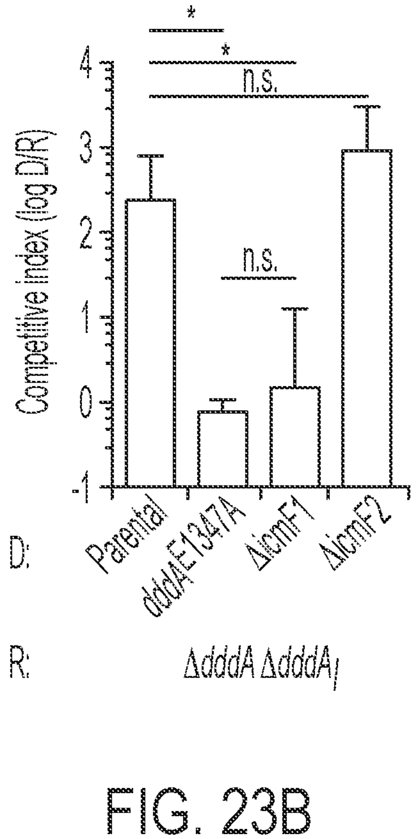

FIG. 22 shows ND5.2-DdCBE edits MT-ND5 efficiently in HEK293T cells without affecting mtDNA copy numbers. MT-ND5.2 editing efficiencies are shown for the different DdCBE orientations 3 days post-transfection. mtDNA levels of MT-ND6-edited cells were measured by quantitative PCR (qPCR) relative to untreated cells. mtDNA levels were normalized to beta-actin. E, efficiency of qPCR FIGS. 23A-23I show that DddA is a double-stranded DNA cytidine deaminase that mediates T6SS-dependent T6SS-interbacterial antagonisms. FIG. 23A is a schematic depicting domains of full-length DddA. The C-terminal toxin domain (tox) used in later experiments is shown in purple. FIG. 23B shows the competitiveness of the indicated donor *B. cenocepacia* strains (D) toward the *B. cenocepacia* ΔdddA $\Delta dddA_1$ recipient strain (R), which is sensitized to DddA intoxication. Values and error bars represent the mean±s.d. of n=2 technical replicates indicative of at least six biological replicates. *P<0.05 by Student's unpaired two-tailed t-test.

Figure 23C:
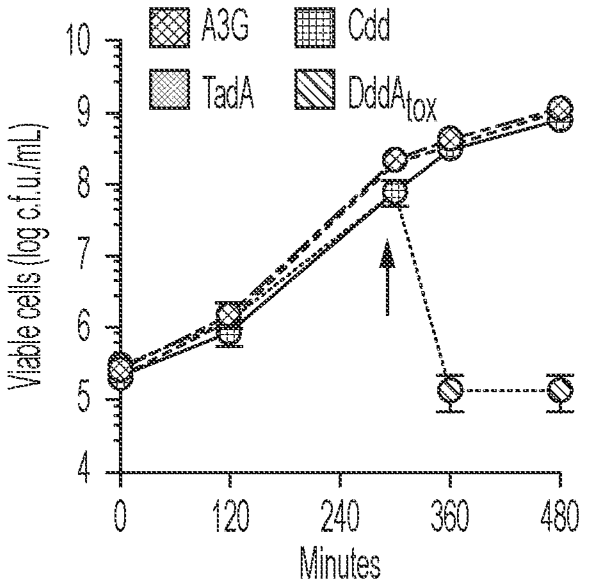
Figure 23D:
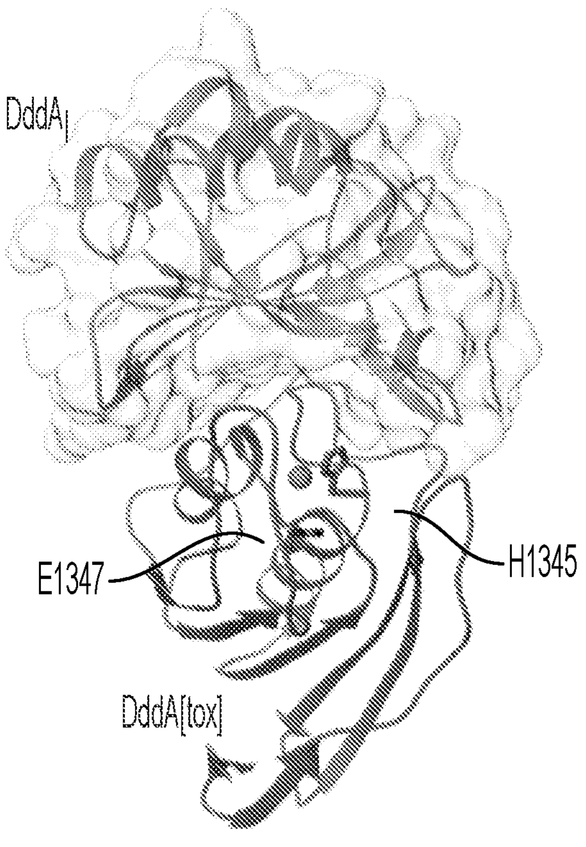
Figure 23E:
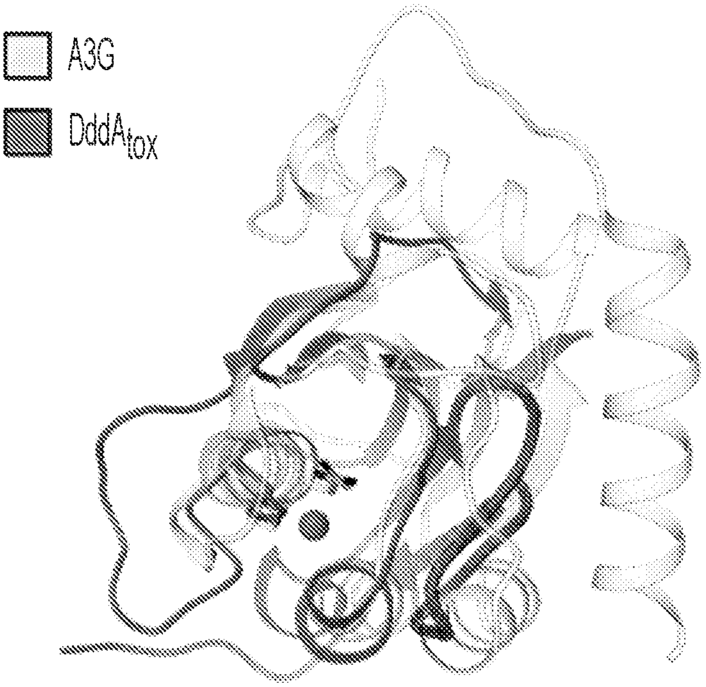
Figure 23F:
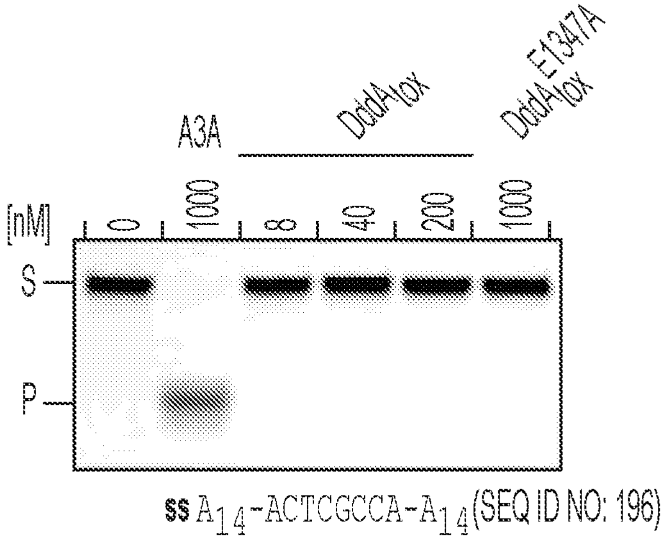
Figure 23G:
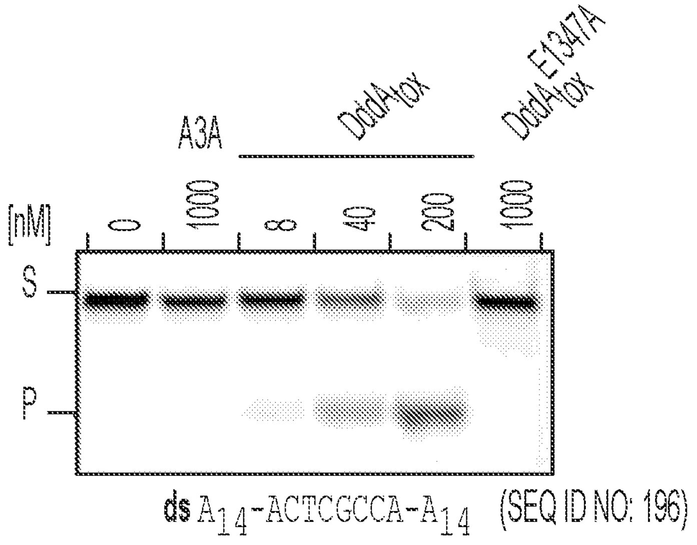
Figure 23H:
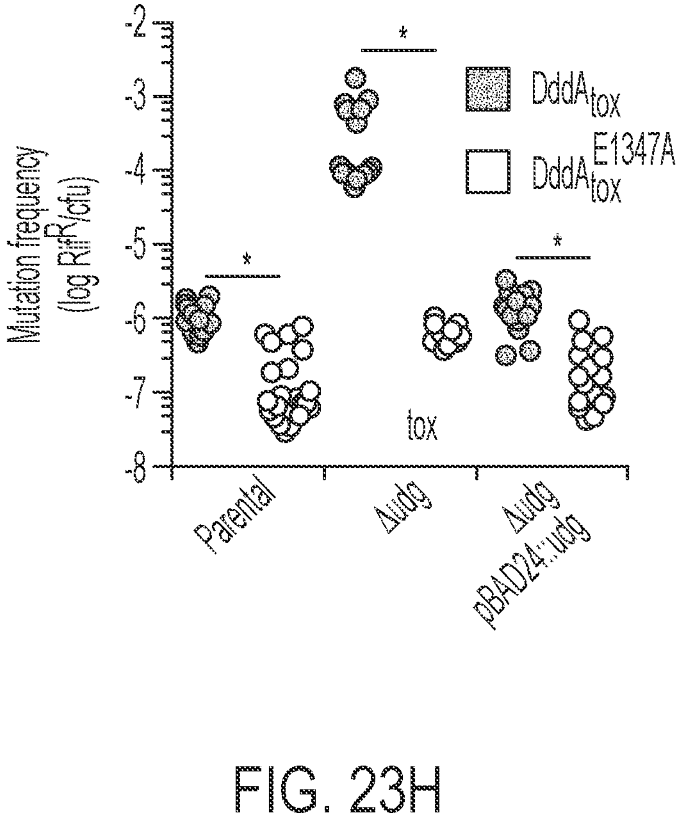
Figure 23I:
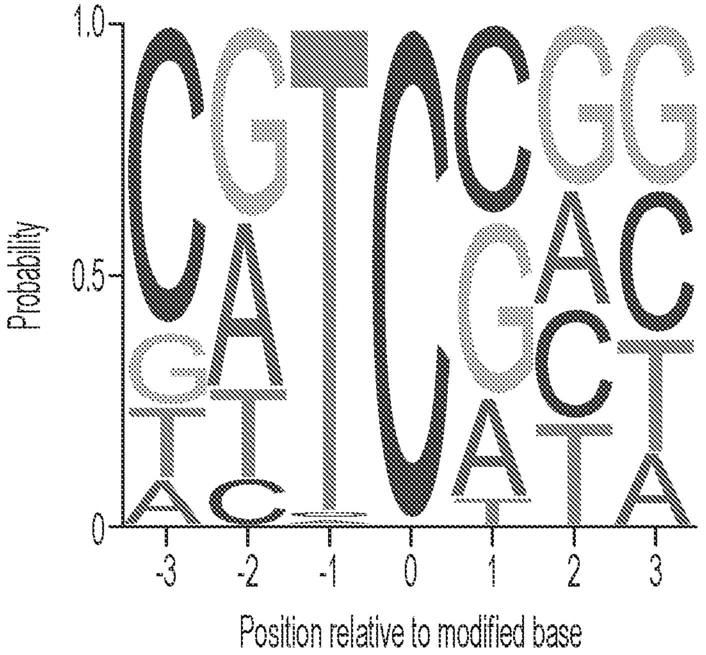

FIG. 23C shows the viability of *E. coli* populations expressing the indicated deaminases. The arrow indicates time of induction of the specified genes. Values and error bars represent the mean±s.d. of n=2 technical replicates indicative of at least three biological replicates. FIG. 23D is a schematic of the crystal structure of $DddA_{tox}$ (ribbon) complexed with $DddA_i$(space filling). The $DddA_{tox}$-associated $Zn^{2+}$ ion is shown and residues critical to $Zn^{2+}$ coordination (H1345) and catalysis (E1347) are indicated. FIG. 23E shows the structural alignment of $DddA_{tox}$, and APOBEC3G. The extended intervening loop of $DddA_{tox}$ not present in APOBEC3G is shown. FIGS. 23F-23G show in vitro cytidine deamination assays using a synthetic double-stranded, as shown in FIG. 23F, or single-stranded 36-nt DNA substrate (S) containing AC. TC, CC, and GC, as shown in FIG. 23G. Cytidine deamination leads to products (P) with increased mobility (15-21nt). A3A, APOBEC3A. FIG. 23H shows the mutation frequency as measured by spontaneous rifampicin resistance emergence in the indicated *E. coli* strains expressing $DddA_{tox}$ or catalytically inactivated $DddA_{tox}$(E1347A) *P>0.05 by unpaired two-tailed t-test. FIG. 23I shows a probability logo of the region flanking SNPs identified in five *E. coli* Δung isolates serially exposed to a low level of $DddA_{tox}$.

Figure 24A:
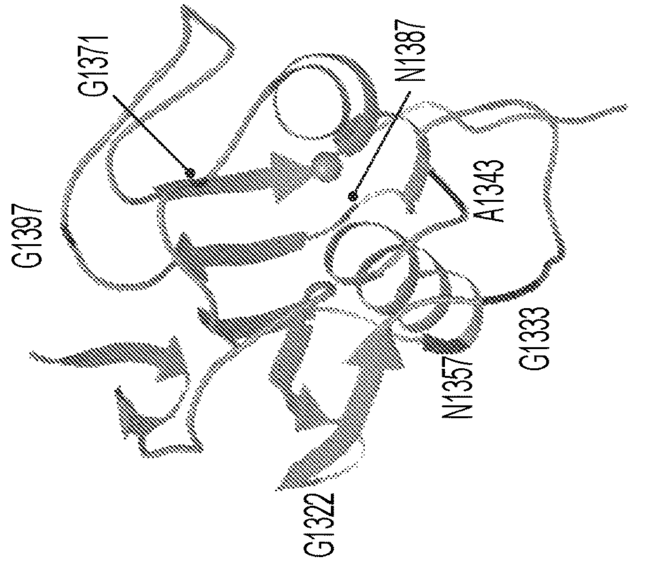
Figure 24B:
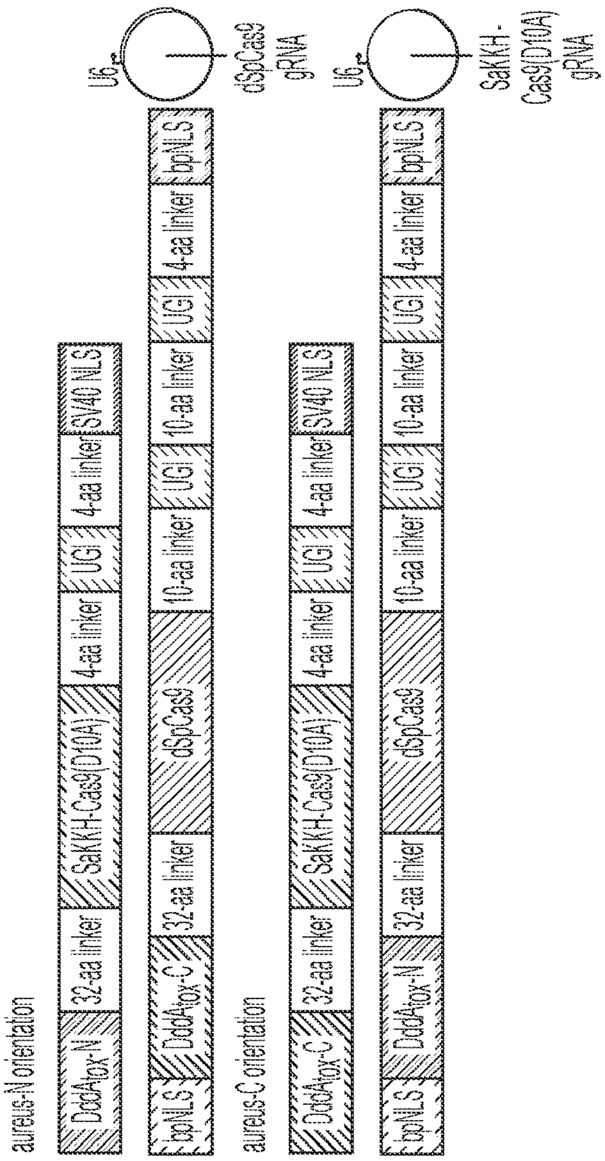
Figure 24C:
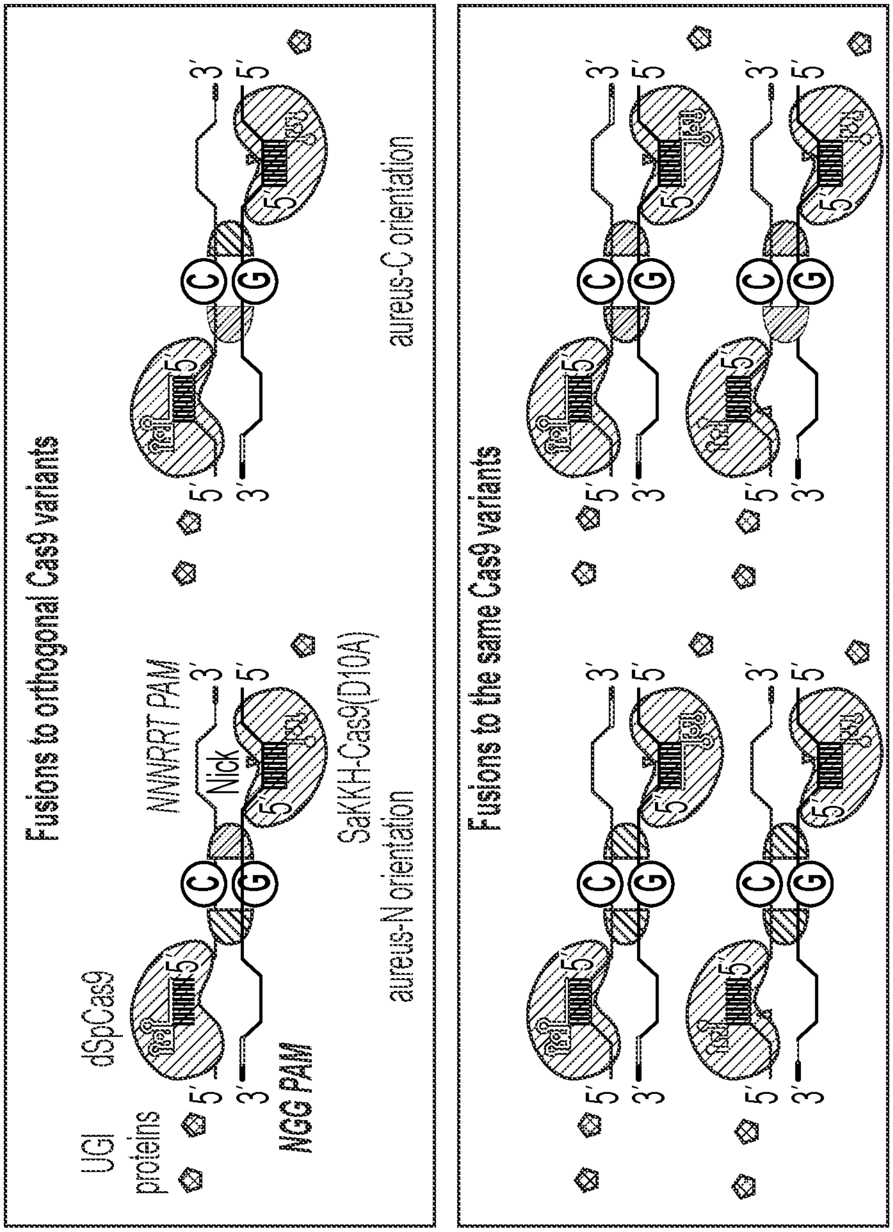
Figure 24D:
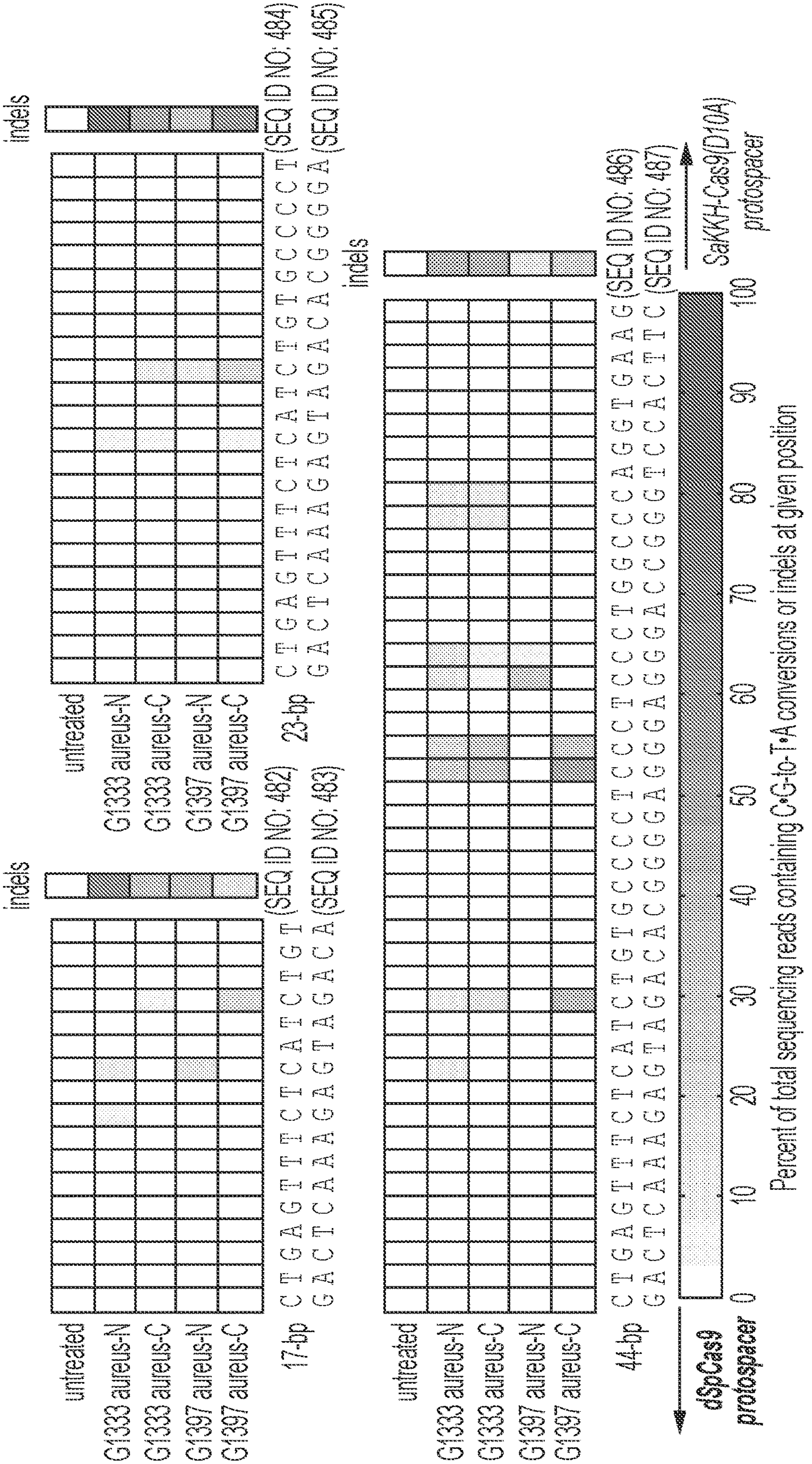

FIGS. 24A-24D show how engineering non-toxic split-$DddA_{tox}$ halves can reconstitute activity when co-localized on DNA. FIG. 24A shows the rational design of seven split sites in apo-$DddA_{tox}$. The zinc ion is shown in grey. $DddA_{tox}$ was split at the peptide bond between the labelled amino acid and the residue immediately after. FIG. 24B shows architectures of split-$DddA_{tox}$ halves fused to the N-terminus of orthogonal Cas9 proteins dSpCas9 and SaKKH-Cas9 (D10A). DddAtox-N and DddAtox-C contain the N-terminus and C-terminus of DddAtox, respectively. Two fusion orientations (aureus-N or aureus-C) are possible for a given split. Guide RNAs are encoded on separate plasmids and transcribed from a U6 promoter. FIG. 24C shows fusions of split-DddAtox halves to orthogonal dSpCas9 and SaKKH-Cas9(D10A) enable reassembly of active DddAtox (top). If split-$DddA_{tox}$ halves are instead fused to the same Cas9 variant, half of reassembled $DddA_{tox}$ is predicted to be non-functional (bottom). FIG. 24D is a heat map of editing efficiencies for G1333 and G1397 splits at the nuclear DNA site EMX1. Each split was assayed in aureus-N and aureus-C orientations across four lengths of spacing regions. The positions of dSpCas9 (pink) and SaKKH-Cas9(D10A) (blue) protospacers are shown. At nucleotide positions containing a canonical T, indels can result in <100% T, as reflected by the heat map. Colors reflect the mean of n=2 independent biological replicates.

Figure 25A:
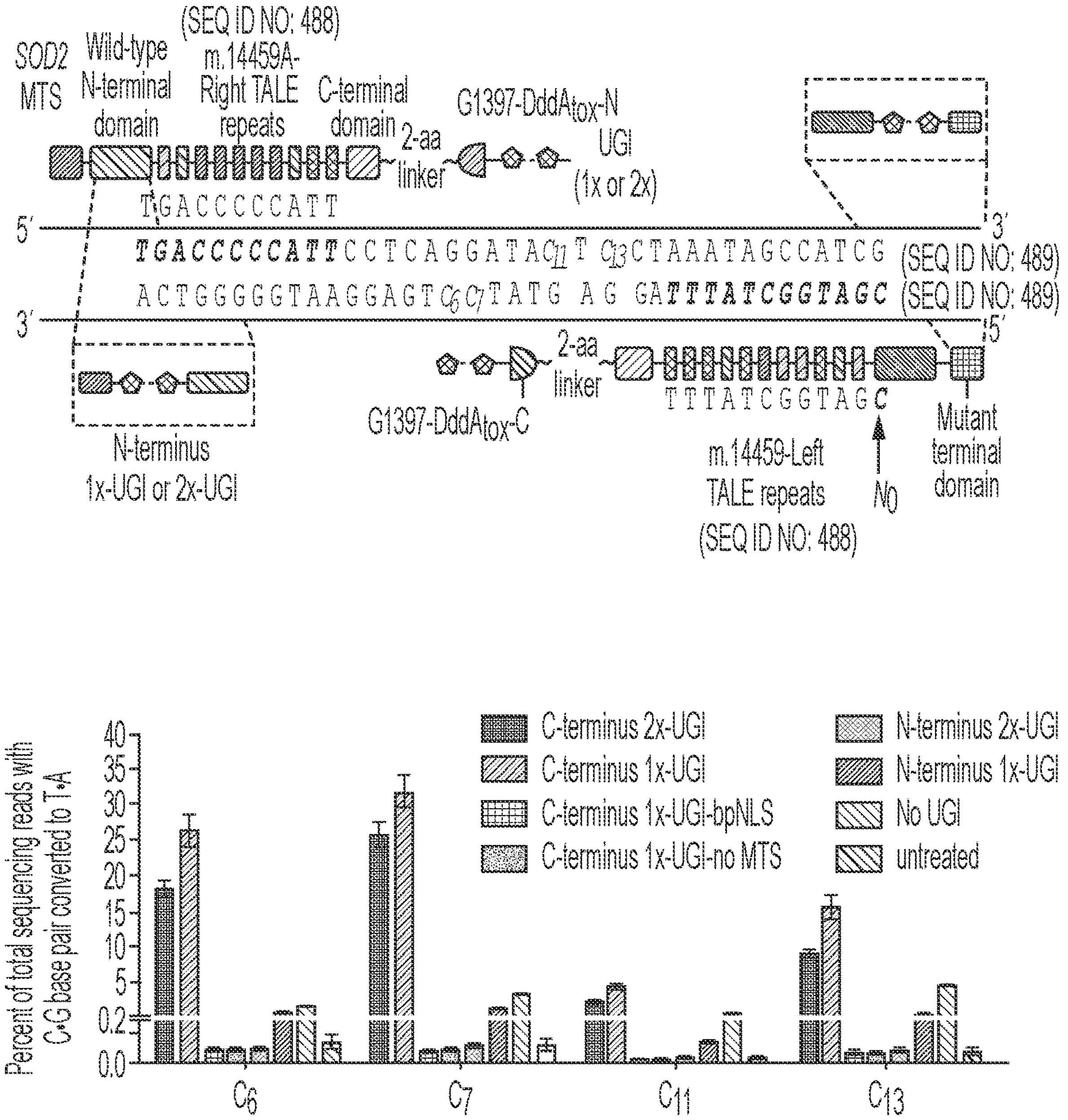
Figure 25B:
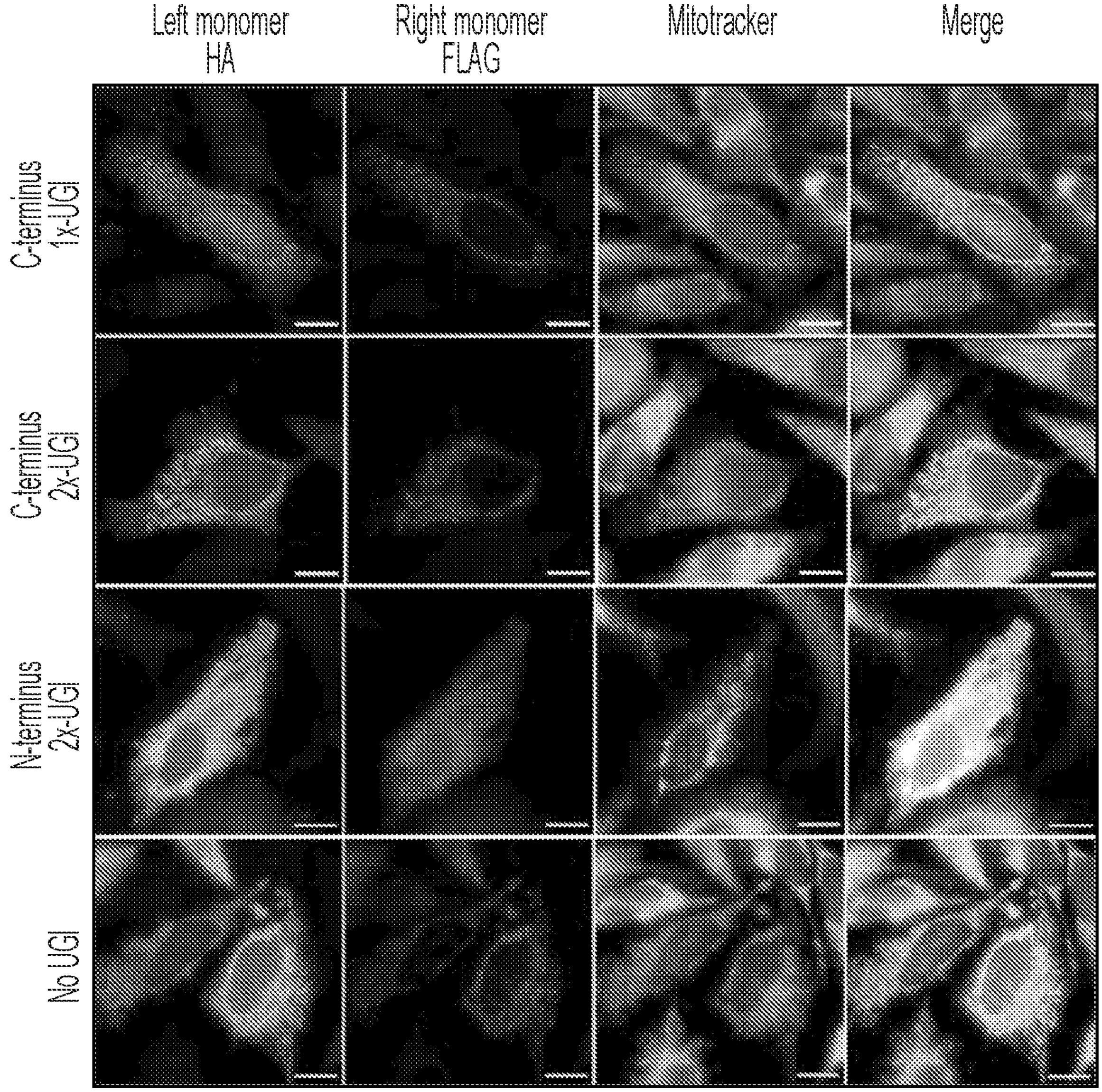
Figure 25C:
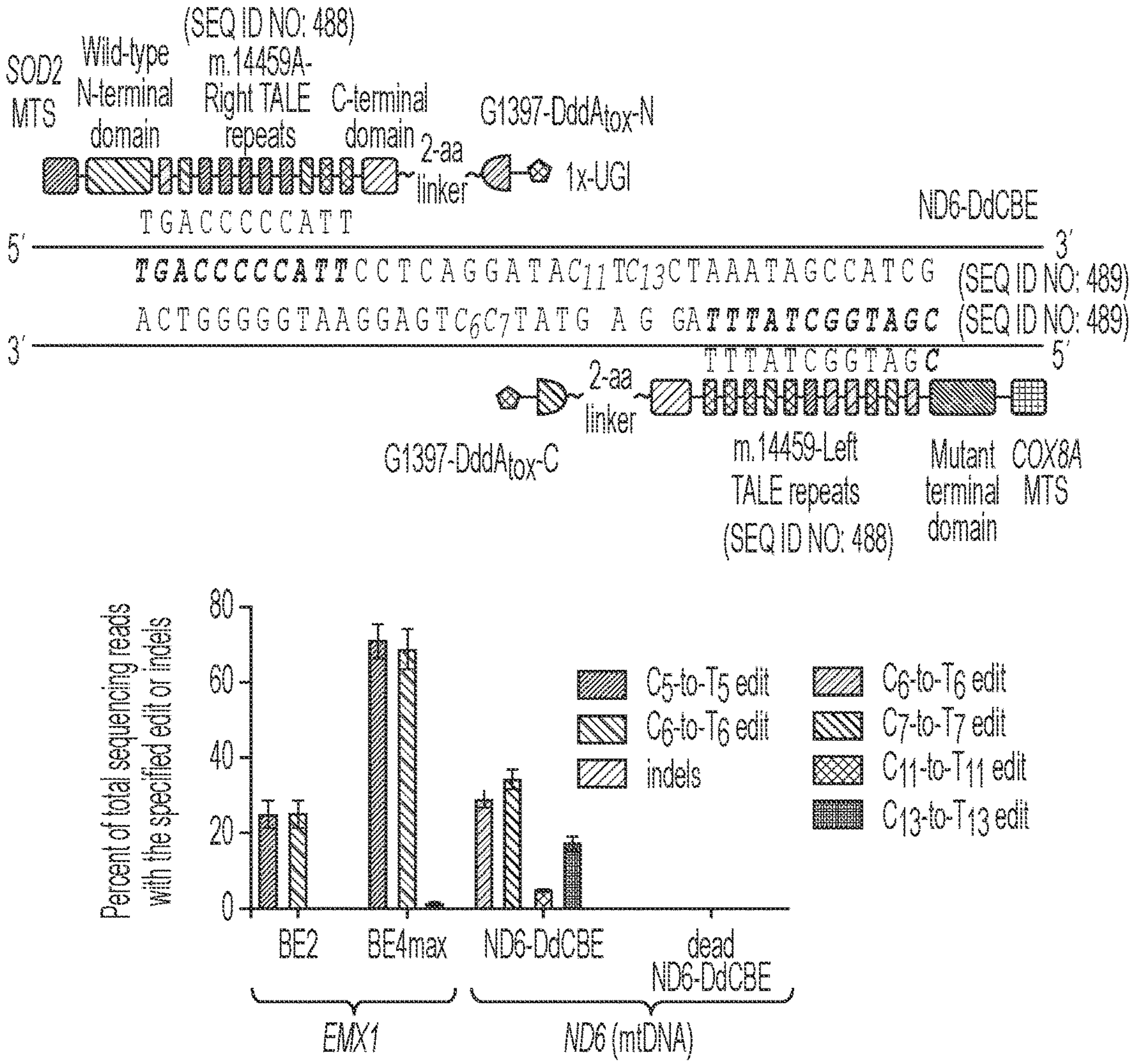
Figure 25D:
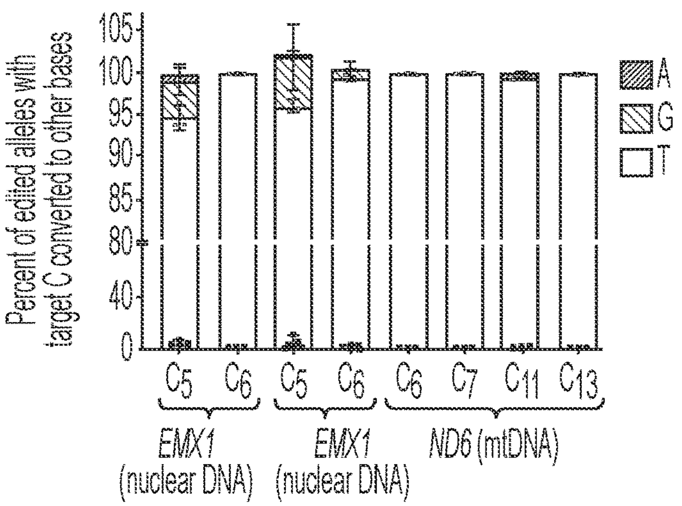
Figure 25E:
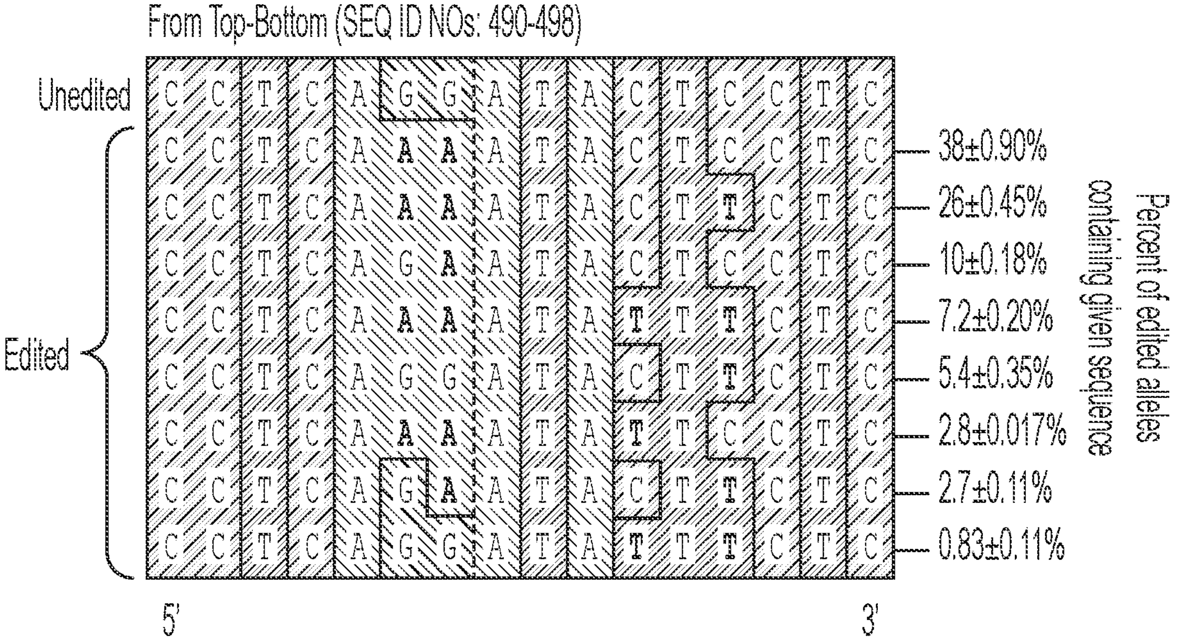

FIGS. 25A-25E show how to optimize mitoTALE-DddA-tox array fusions for mitochondrial base editing in human cells. FIG. 25A is a schematic of unoptimized m.14459A-TALE-DddAtox array fusions that bind to DNA flanking a 15-bp spacing region in mitochondrial ND6 (see FIG. 34C for editing efficiencies). Target cytidines are shown in C11, C13, C6, and C7 and mitoTALE binding sites are shown in blue. DddAtox was split at G1397 with DddAtox-N fused to the left-side mitoTALE. The N-terminal domain of the right-side mitoTALE was engineered to recognize cytidine at the N0 position55. ND6 editing efficiencies of fusions containing 1x- or 2x-UGI proteins at the N- or C-terminus are shown below. Fusions containing bpNLS instead of MTS, or lacking any localization signal sequence, were included as negative controls. FIG. 25B shows fluorescence imaging of HA- and FLAG-tagged halves of N-terminus UGI-mitoTALE-DddAtox and C-terminus mitoTALE-Dd-$dA_{tox}$-UGI pairs in HeLa cells 24 h after plasmid transfection. Mitochondrial localization was determined by staining with Mitotracker. Scale bar. 10 μM. FIG. 25C shows optimized DdCBE architecture containing one UGI protein fused to the C-terminus of each fusion. Editing efficiencies and indel frequencies of mitochondrial-localized ND6-DdCBE targeting ND6 in mtDNA and nuclear-localized BE2 and BE4max targeting EMX1 in nuclear DNA are shown. FIG. 25D shows product purity among edited DNA sequencing reads in which the specified target C is shown for the indicated nuclear (BE2 (left) and BE4max (middle)) or mitochondrial (ND6-DdCBE) base editors. FIG. 25E is a ND6 allele frequency table obtained from HEK293T cells treated with ND6-DdCBE. All values and errors for FIGS. 25A, and 25C-25E reflect the mean±s.d. of n=3 independent biological replicates.

Figure 26A:
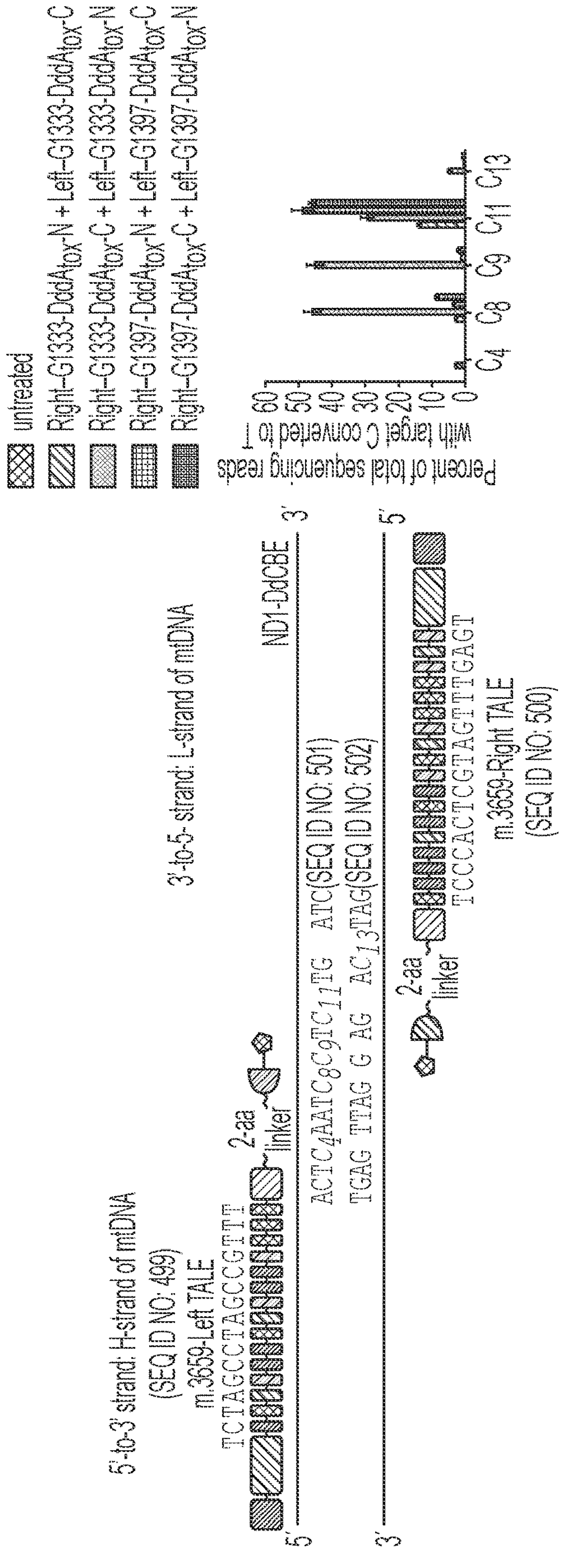
Figure 26B:
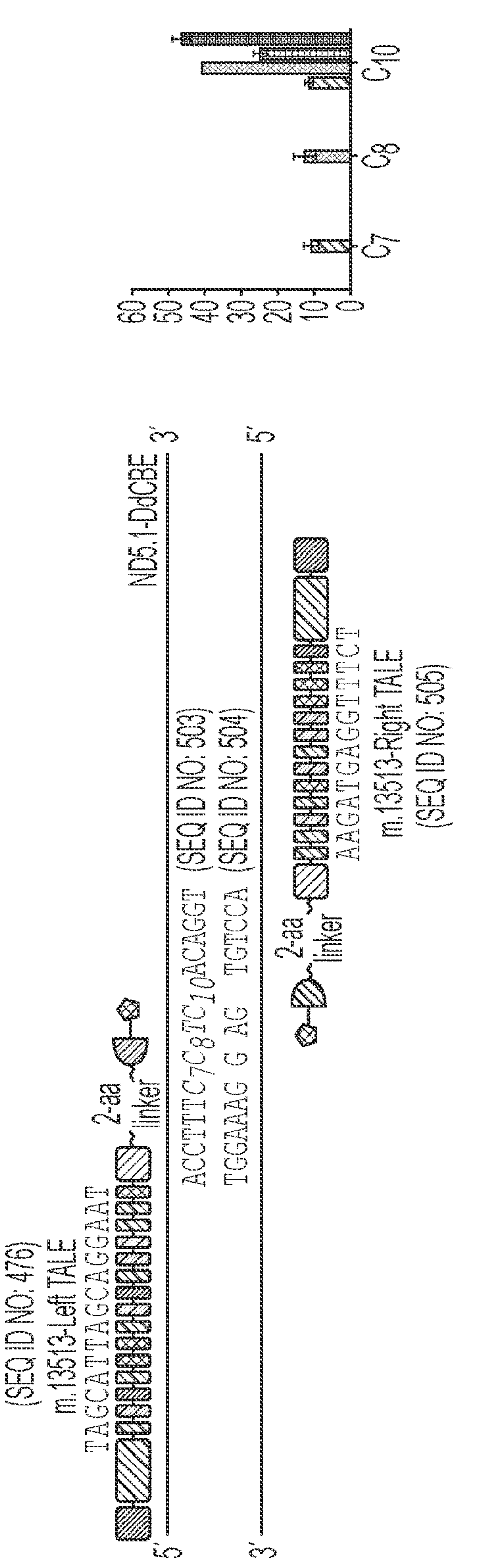
Figure 26C:
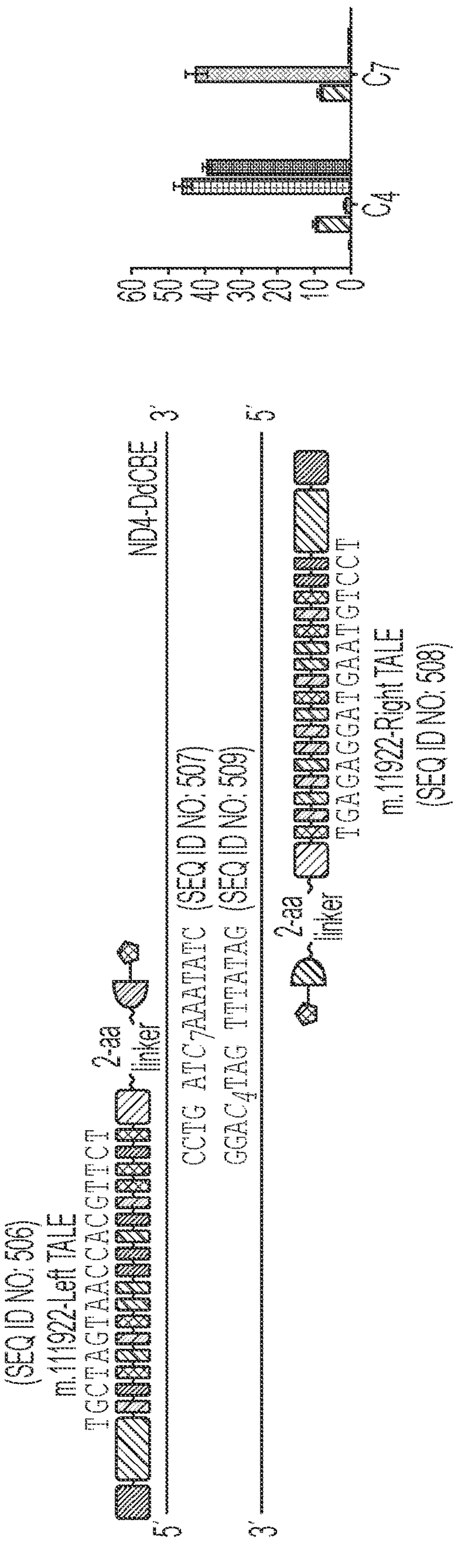
Figure 26D:
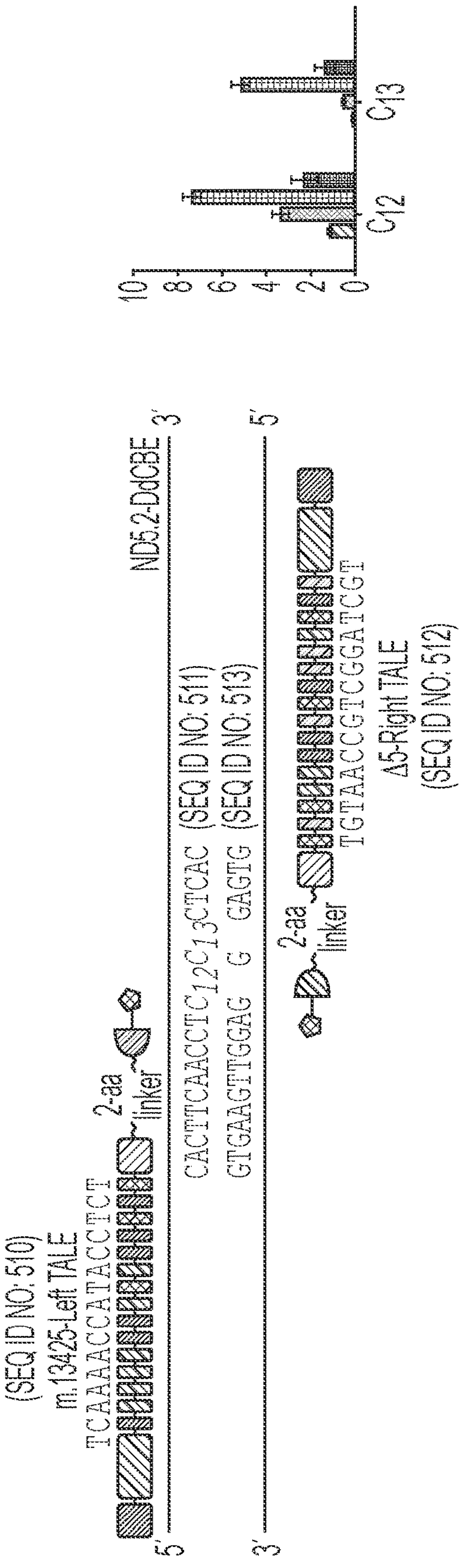
Figure 26E:
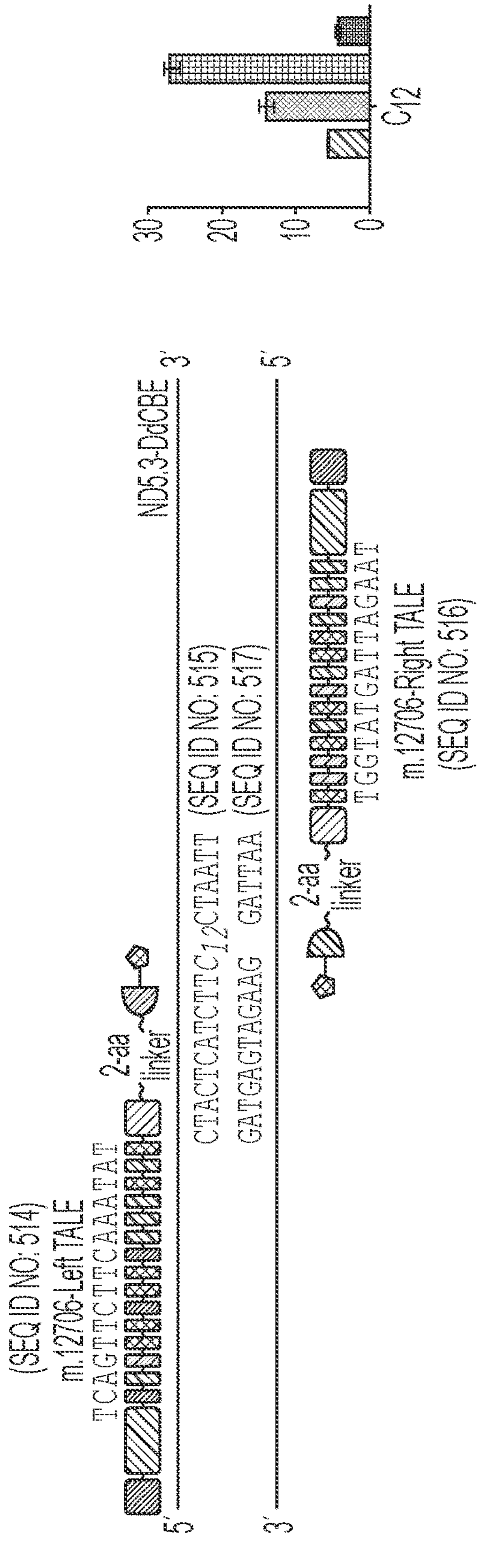
Figure 26F:
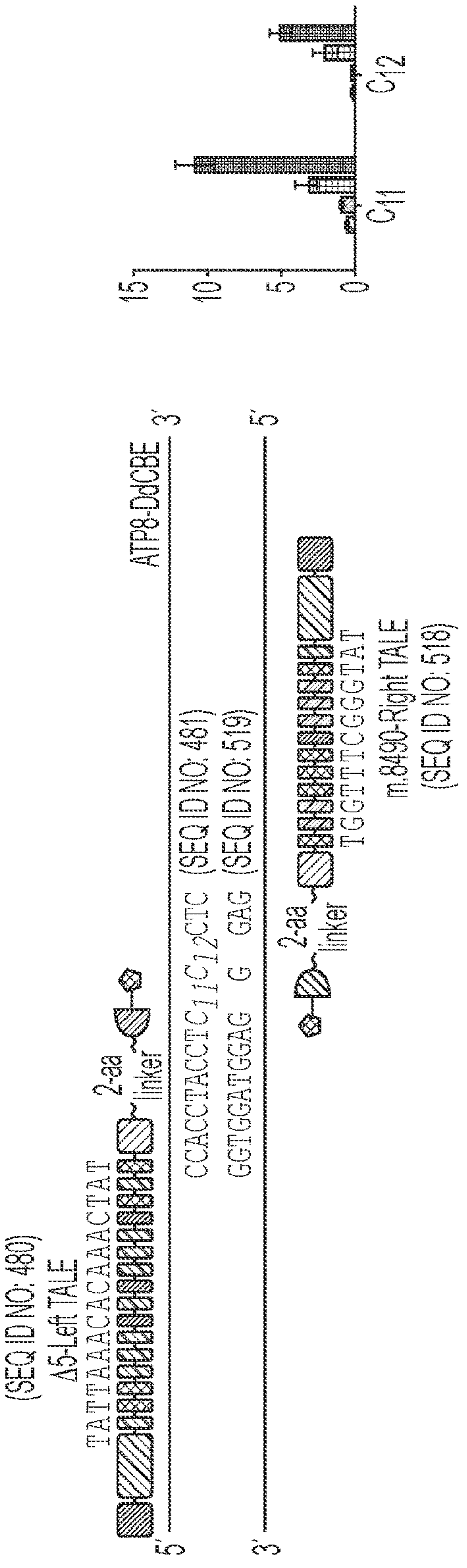
Figure 26G:
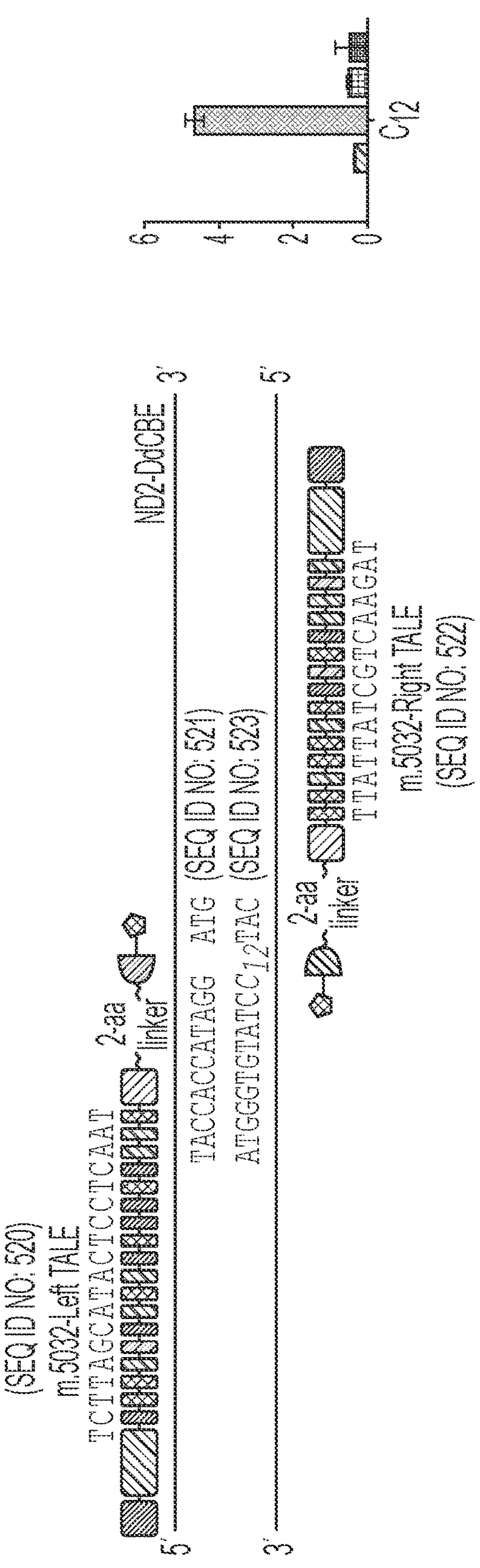
Figure 26H:
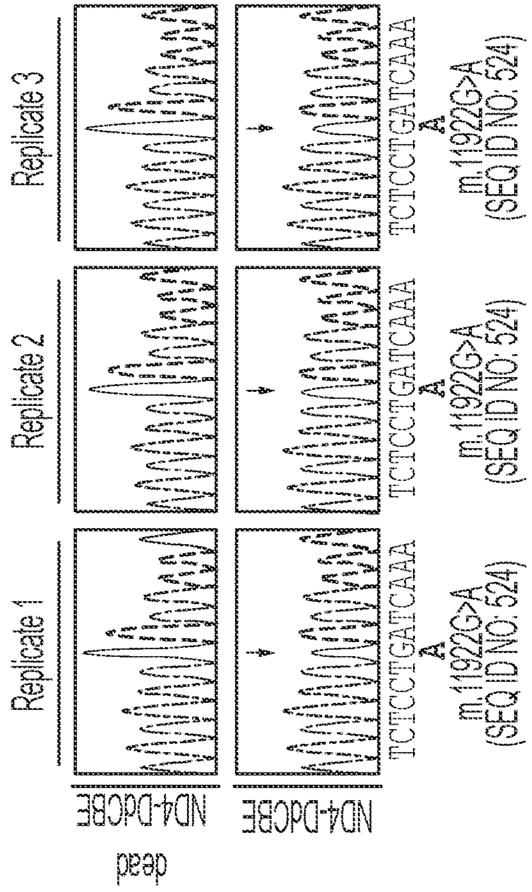
Figure 26I:
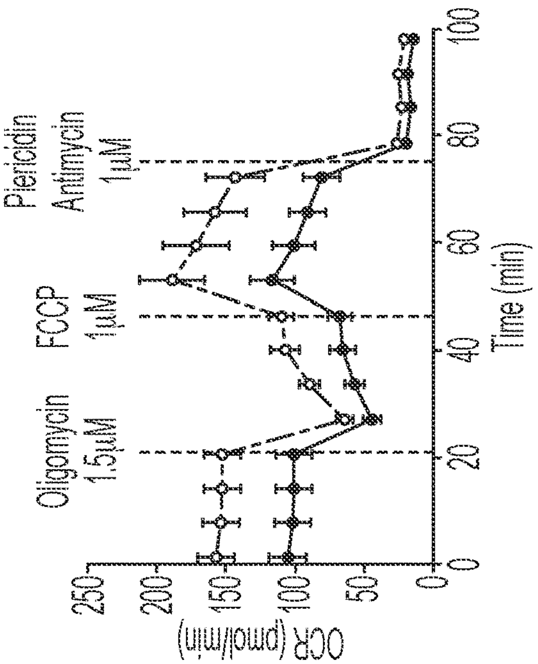
Figure 26J:
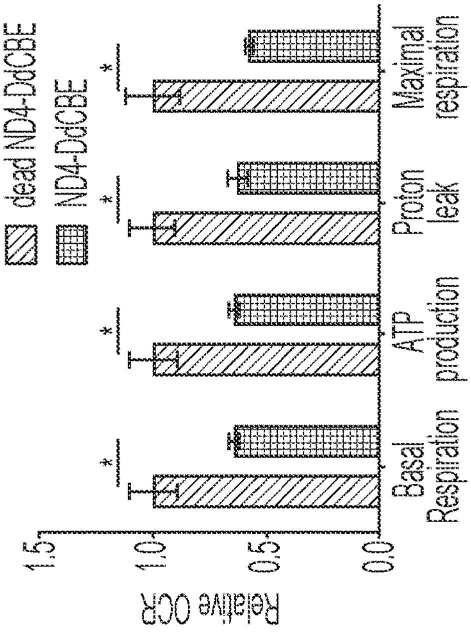

FIGS. 26A-26J show DdCBE editing at five mitochondrial DNA genes in human cells. Schematics of DdCBEs showing their mitoTALE repeats, target dsDNA spacing region, and split $DddA_{tox}$ orientation that resulted in the highest on-target editing efficiencies. Colored components are defined in FIGS. 25A-25E. Editing efficiencies of indicated DdCBE in all possible G1333 and G1397 split orientations are shown (right) for ND1-DdCBE (FIG. 26A), ND5.1-DdCBE (FIG. 26B), ND4-DdCBE (FIG. 26C), ND5.2-DdCBE (FIG. 26D), ND5.3-DdCBE (FIG. 26E), ATP8-DdCBE (FIG. 26F) and ND2-DdCBE (FIG. 26G). HEK293T cells were transfected with two plasmids, each encoding an MTS-mitoTALE array-split DddAtox-UGI half programmed to bind the mtDNA half-site shown. Genomic DNA was harvested three (FIGS. 26B, 26D, and 26F) or six days (FIGS. 26A, 26C, 26E, 26G) post-transfection and analyzed by high-throughput DNA sequencing. All values and errors in FIGS. 26A-26G reflect the mean±s.d. of n=3 independent biological replicates. FIG. 26H shows the confirmation of m.I 1922G>A ND4 editing by Sanger sequencing in HEK293T cells eight days after transfection with ND4-DdCBE and the catalytically inactivated ND4-DddCBE containing the E1347A mutation in split DddAtox (dead ND4-DdCBE). FIG. 26I shows the oxygen consumption rate (OCR) analyzed by XF Seahorse Analyzer. FIG. 26J shoes relative values of respiratory parameters. All values and errors in (FIG. 26I) and (FIG. 26J) reflect the mean±SEM of n=3 independent biological replicates. For FIG. 26J, asterisks indicate significant OCR difference based on a comparison between ND4-DdCBE edited and dead ND4-DdCBE mock-edited cells. *P<0.05 by Student's two-tailed unpaired t-test.

Figure 27A:
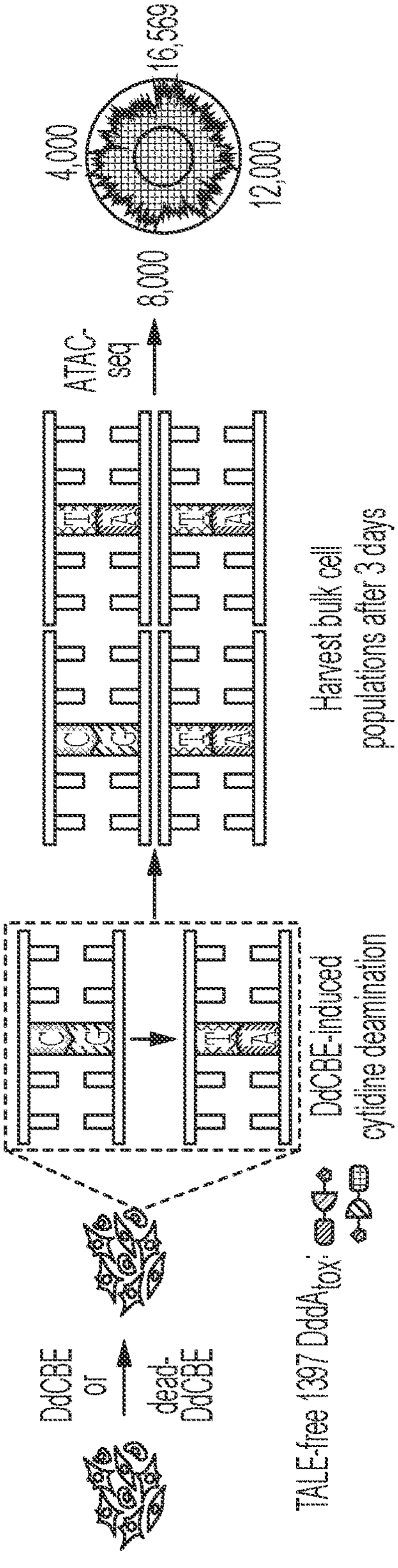
Figure 27C:
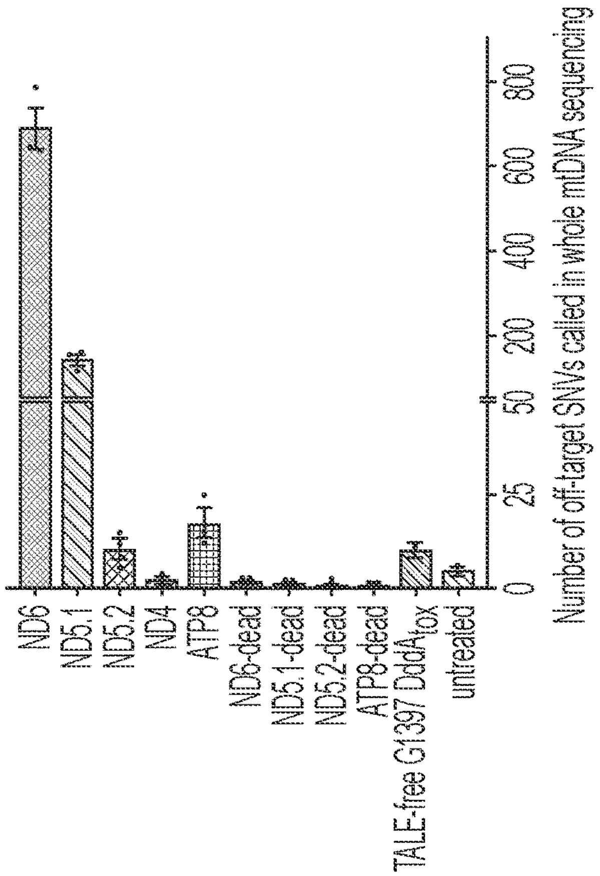
Figure 27B:
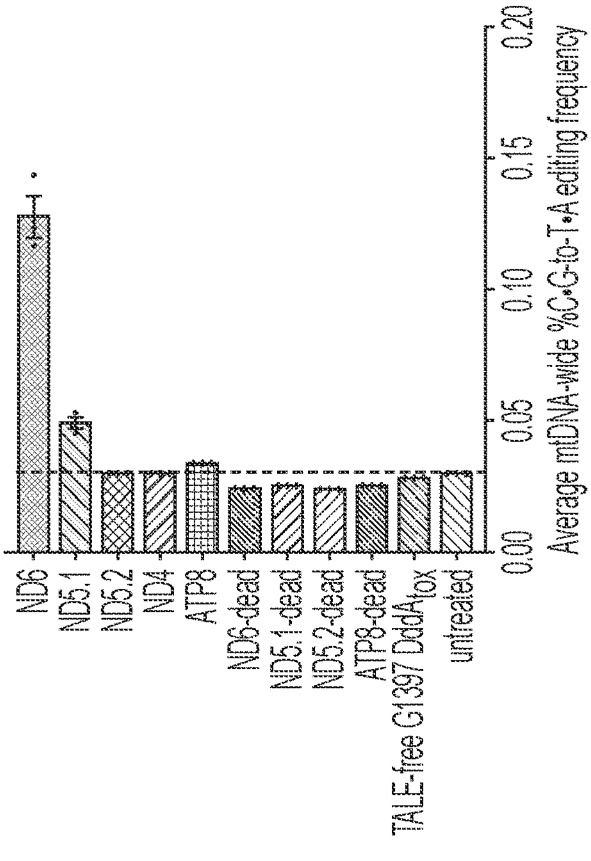
Figure 27E:
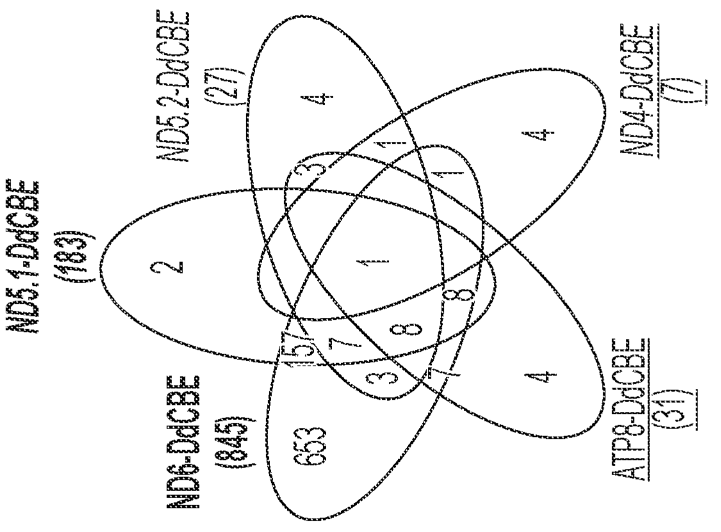
Figure 27D:
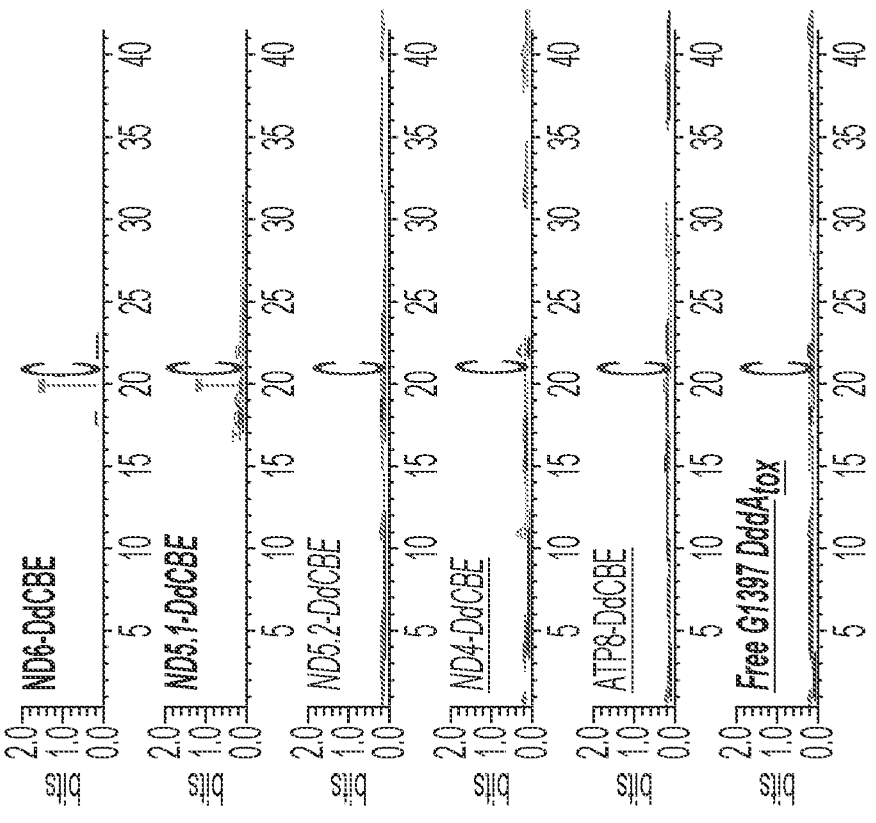

FIGS. 27A-27E show mitochondrial genome-wide off-target DNA editing profiles for DdCBEs. FIG. 27A shows HEK293T cells were transfected with plasmids encoding active DdCBE, the inactive mutant DdCBE (dead-DdCBE) containing DddAtox(E1347A) or TALE-free DddAtox halves split at G1397 (TALE-free 1397 DddAtox, with each half containing MTS-split DddAtox-UGI. 5,000-10,000 cells were harvested after 3 days for bulk-cell ATAC-seq. Each base was sequenced with an average of 5.100-9.900× coverage. The inner circle in the radial plot represents 5,000× coverage and the numbers represent the positions of the human mitochondrial genome. FIG. 27B shows the average % frequency of genome-wide C•G-to-T•A off-target editing in mtDNA by indicated DdCBE and controls (see Methods for quantifying average off-target editing frequencies). The dashed line represents the frequency of endogenous C•G-to-T•A conversions in mtDNA as measured in the untreated control. FIG. 27C shows the number of high-confidence off-target SNVs identified after treatment with the indicated DdCBE or in control samples (see Methods for variant calling workflow, and FIGS. 39A-39F for on- and off-target editing efficiencies of individuals SNVs for each DdCBE). FIG. 27D shows sequence logos generated from off-target C•G-to-T•A conversions by each indicated DdCBE and TALE-free G1397 $DddA_{tox}$. The target cytidine is at position 21. The 20 bases upstream and downstream of the deaminated cytidine represent TALE array binding sites flanking the spacing region that contains the target base. Bits reflect sequence conservation at a given position. FIG. 27E is a Venn diagram[77] depicting the number off-target SNVs shared among two or more DdCBEs. The combined number of unique SNVs for each DdCBE from all three independent biological replicates is indicated in parenthesis. All values and errors in (FIG. 27B) and (FIG. 27C) reflect the mean±SEM of n=3 independent biological replicates.

Figure 28A:
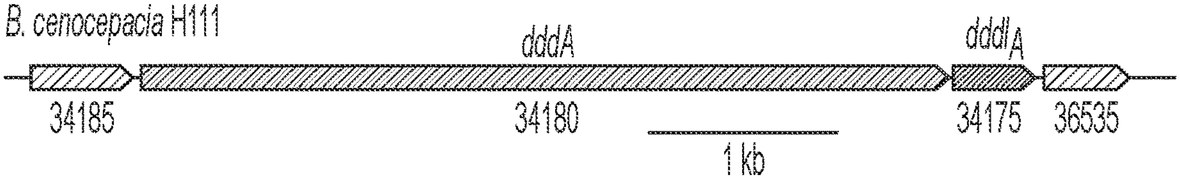
Figure 28B:
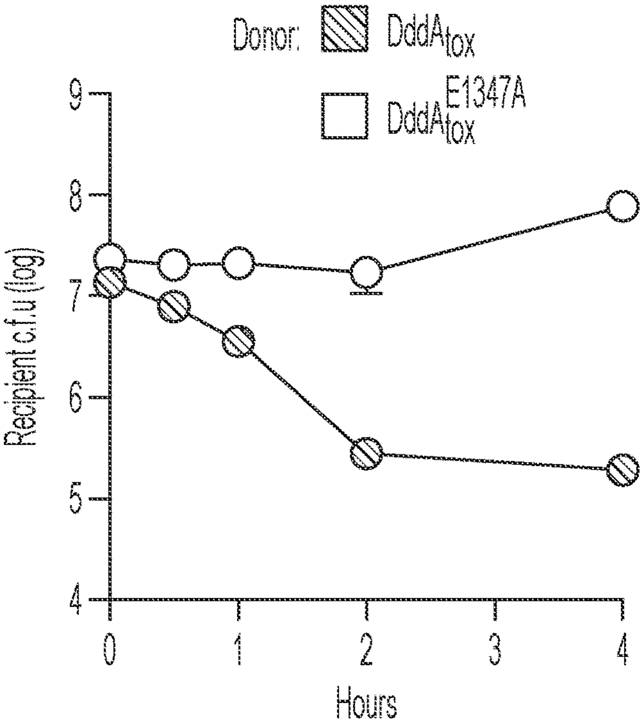
Figure 28C:
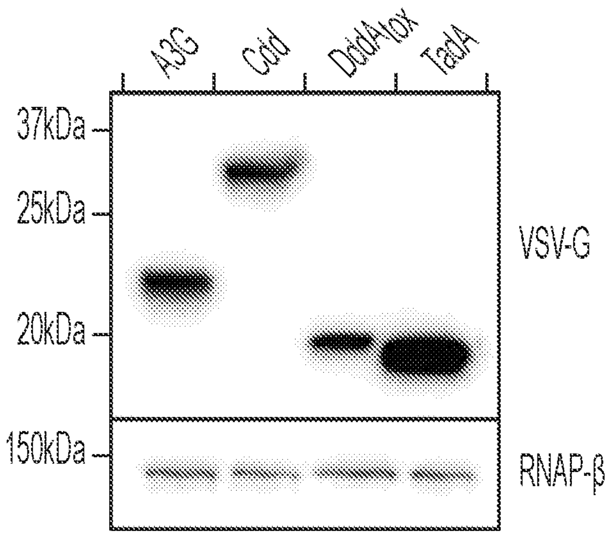

FIGS. 28A-28C show that DddA is encoded adjacent to a predicted immunity gene and exhibits bactericidal activity during interbacterial competition. FIG. 28A shows genomic context of dddA and dddIA in *B. cenocepacia* H111. FIG. 28B shows the viability of *B. cenocepacia* ΔdddA ΔdddIA (recipient) over time during competition with *B. cenocepacia* donor strains carrying wild-type dddAtox or dddAtoxE1347A. Data represent the mean±s.d. of n=2 technical replicates indicative of at least three biological replicates. FIG. 28C shows a α-VSV-g western blot analysis of total cell lysates of *E. coli* expressing the indicated deaminases tagged with VSV-G epitope. RNAP-0 is used as a loading control.

Figure 29A:
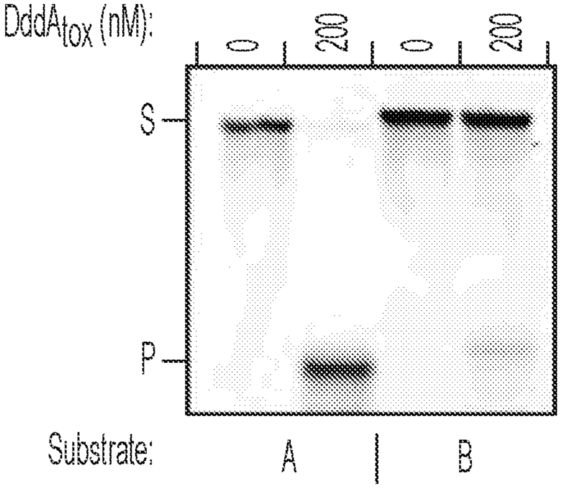
Figure 29B:
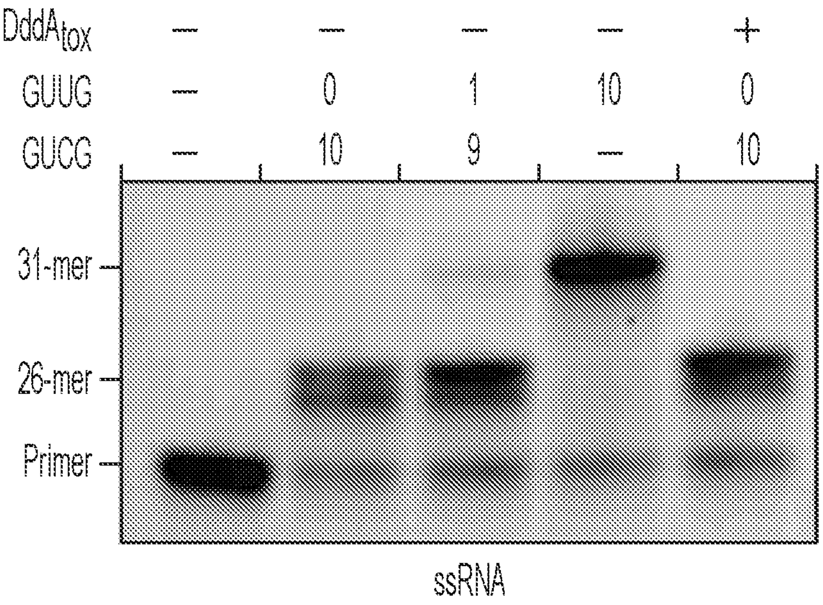
Figure 29C:
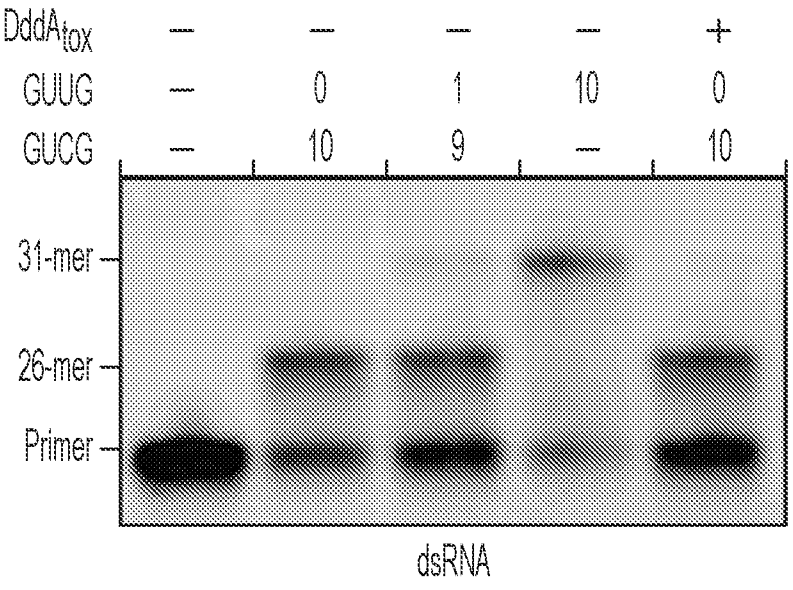

FIGS. 29A-29C show an analysis of $DddA_{tox}$ activity against dsDNA and RNA substrates. FIG. 29A shows an in vitro DNA cytidine deamination assays using double-stranded 36-nt DNA substrates containing AC, TC, CC, and GC with a FAM fluorophore on the forward (A) or reverse (B) strand. Deamination activity results in a cleavage product (P). FIG. 29B and FIG. 29C show a poisoned primer extension assay to detect deamination of cytidine in single-(FIG. 29B) or double-(FIG. 29C) stranded RNA substrates. A mix of RNA substrates containing the sequences GUCG or GUUG at the indicated ratios were incubated with purified $DddA_{tox}$ and reverse transcriptase. Primer extension was performed in reactions with ddGTP to terminate primer extension at cytidine residues. Cytidine deamination yields the 31-mer product.

Figure 30A:
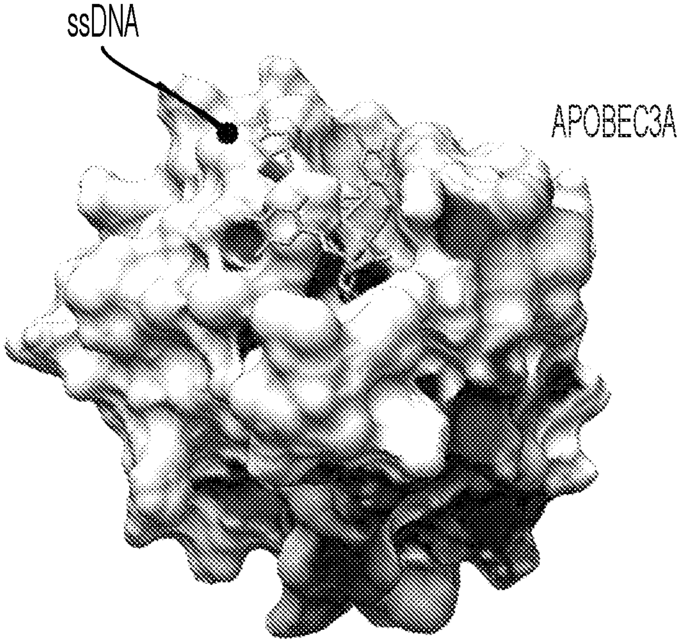
Figure 30B:
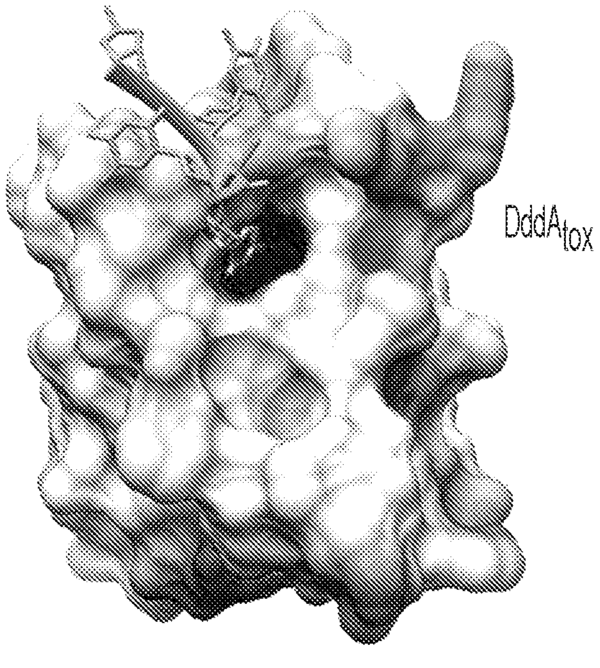

FIGS. 30A-30B show predicted nucleotide interactions of $DddA_{tox}$ compared to those of APOBEC3A. FIG. 30A is a schematic showing an electrostatic surface potential rendering of human APOBEC3A in complex with single-strand DNA (PDB 5SWW)[78]. FIG. 30B is a model for $DddA_{tox}$ (electrostatic surface rendering) interaction with double-stranded DNA, based on superposition with the APOBEC3A structure. The substrate cytidine is shown for (FIG. 30A) and (FIG. 30B).

Figure 31A:
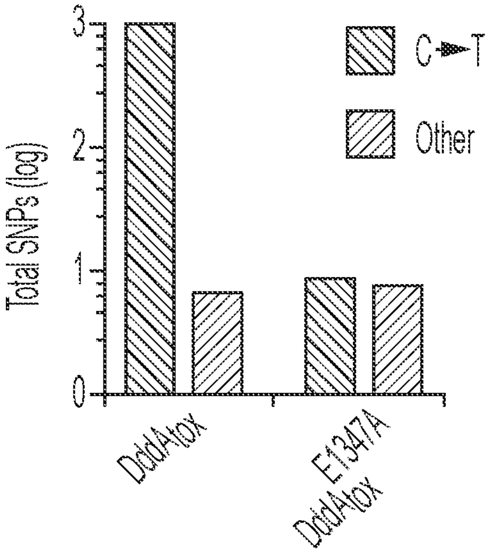

FIGS. 31A-31D show that DddAtox deaminate cytidines in bacteria and exhibit sequence context preference. FIG. 31A shows the number of SNPs from the indicated nucleotide classifications observed in *E. coli* Δudg following intoxication with $DddA_{tox}$ or DddAtox(E1347A). FIGS.

Figure 31B:
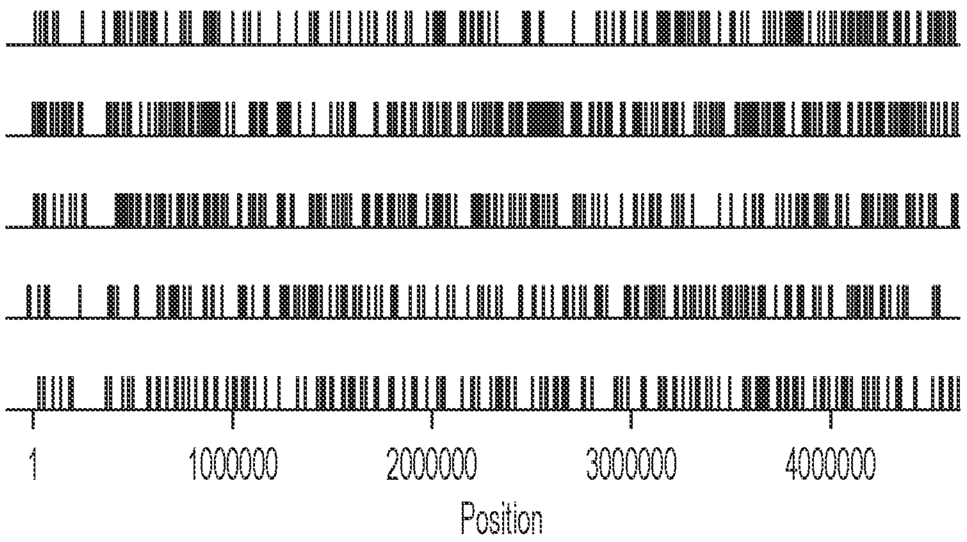
Figure 31C:
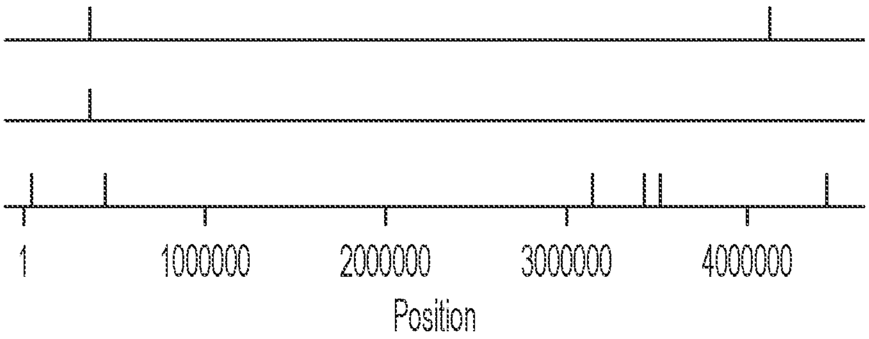
Figure 31D:
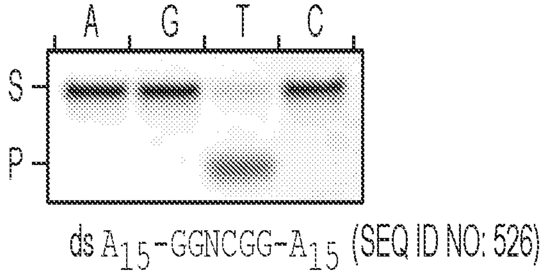

31B-31C show the position of SNPs on the chromosome of *E. coli* Δudg isolates intoxicated with DddAtox (FIG. 31B) or DddAtox(E1347A) (FIG. 31C). FIG. 31D shows a deamination assay on DddAtox with double-stranded DNA substrates containing a single C with different nucleotides (A, T, C, or G) at the position immediately 5' of the C (fourth nucleotide as read left to right) (S, substrate; P, product).

Figure 32A:
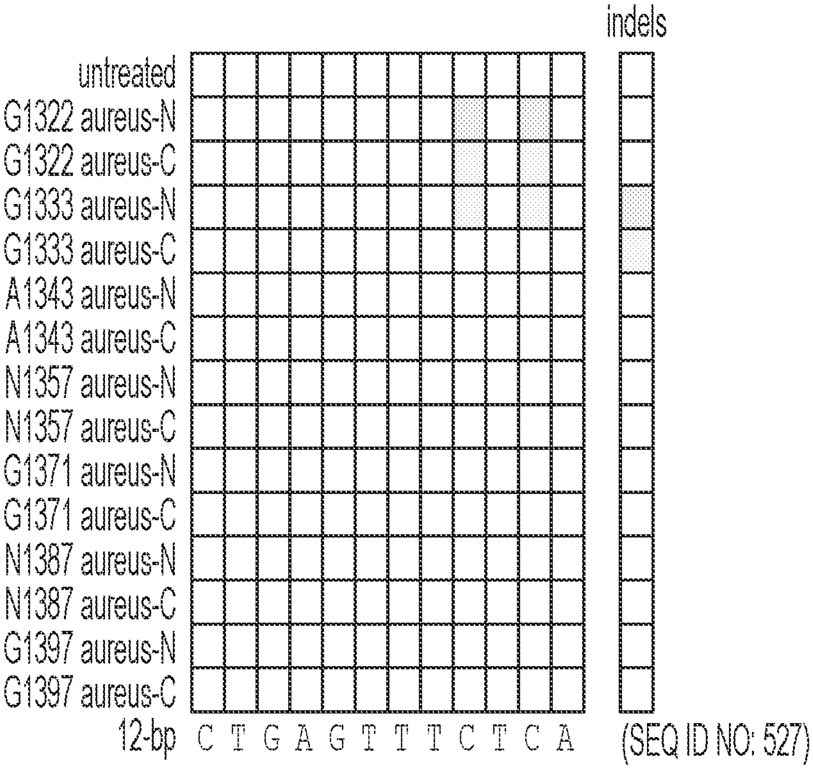
Figure 32B:
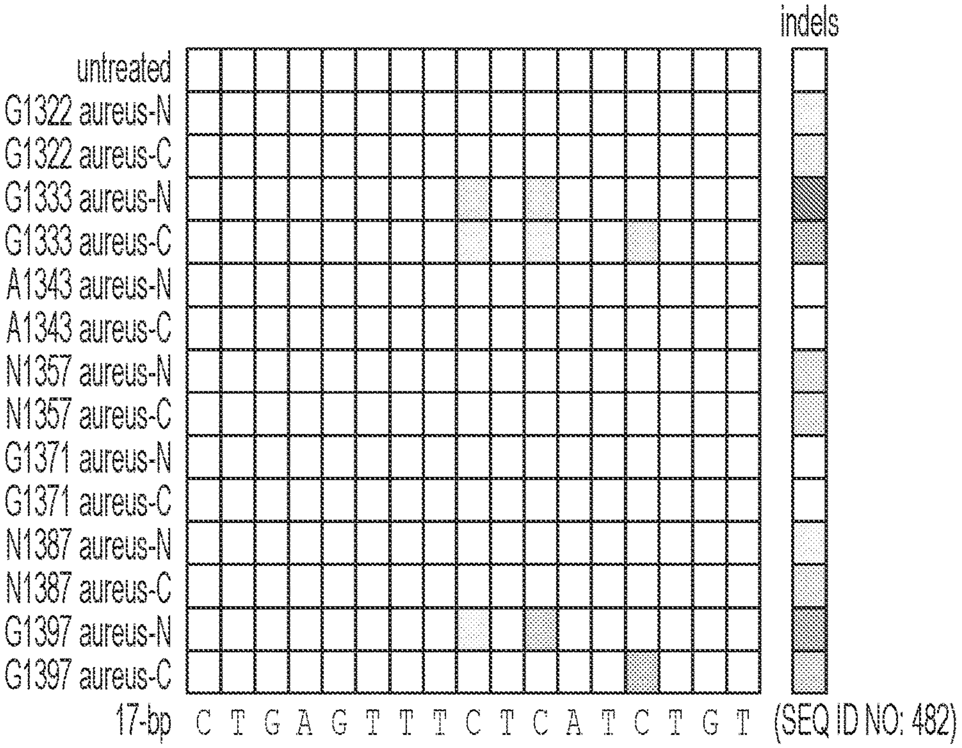
Figure 32C:
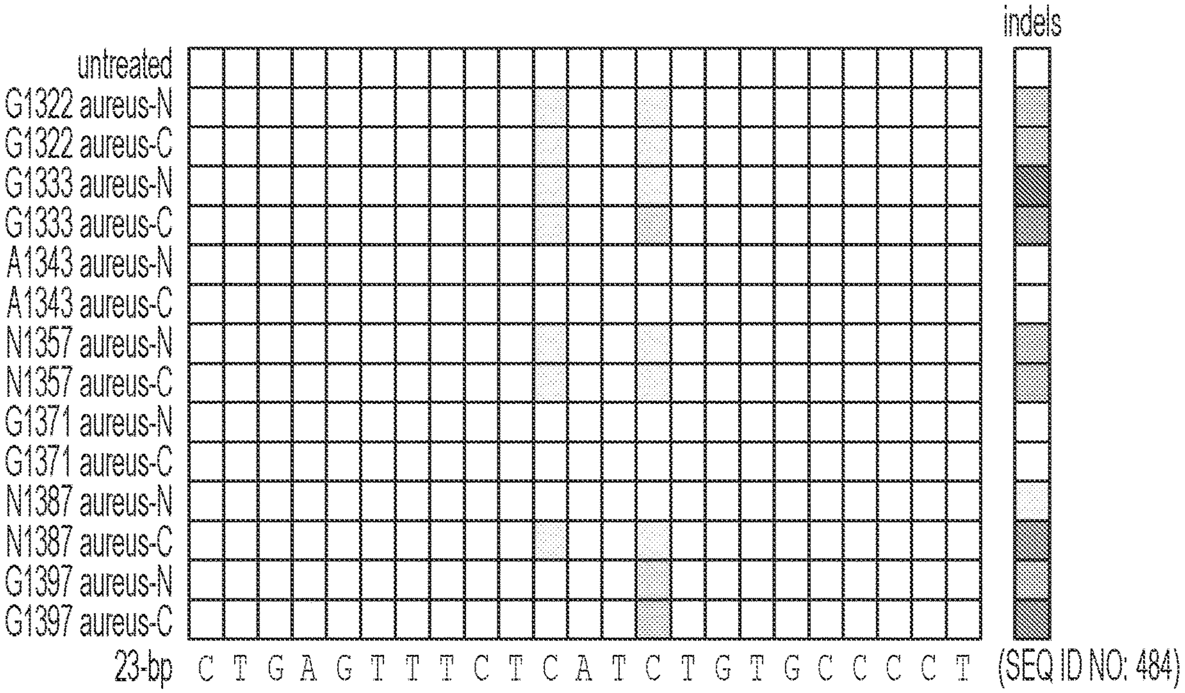
Figure 32D:
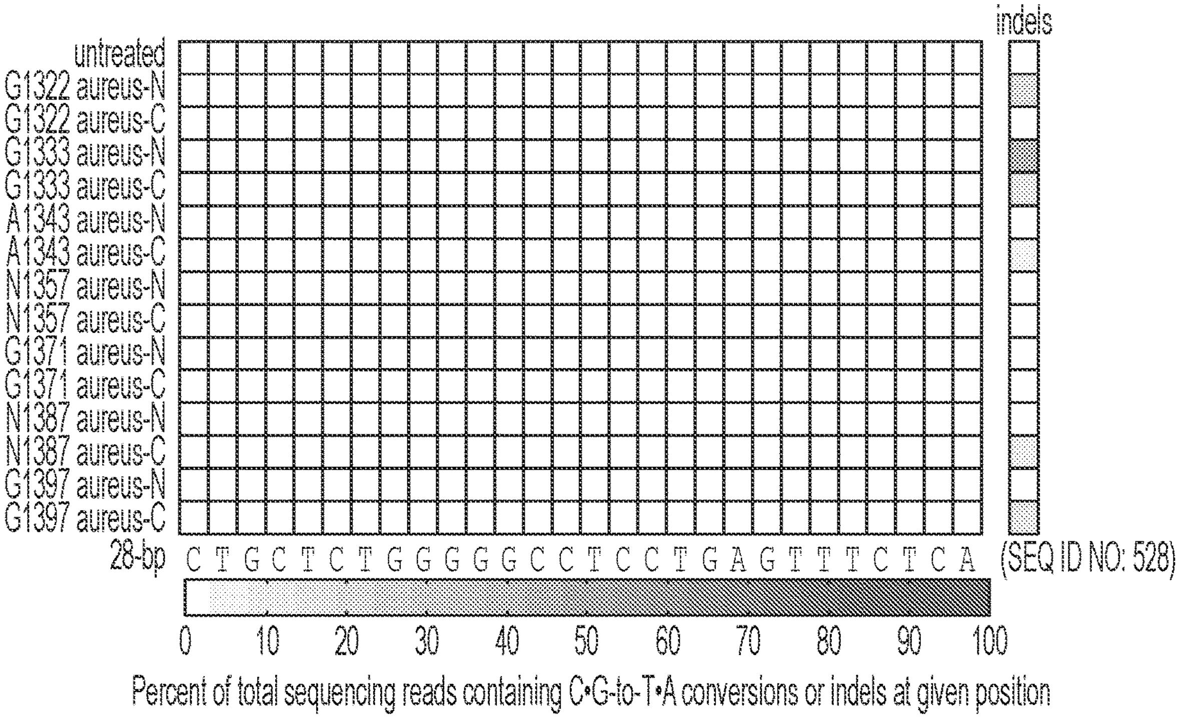
Figure 32E:
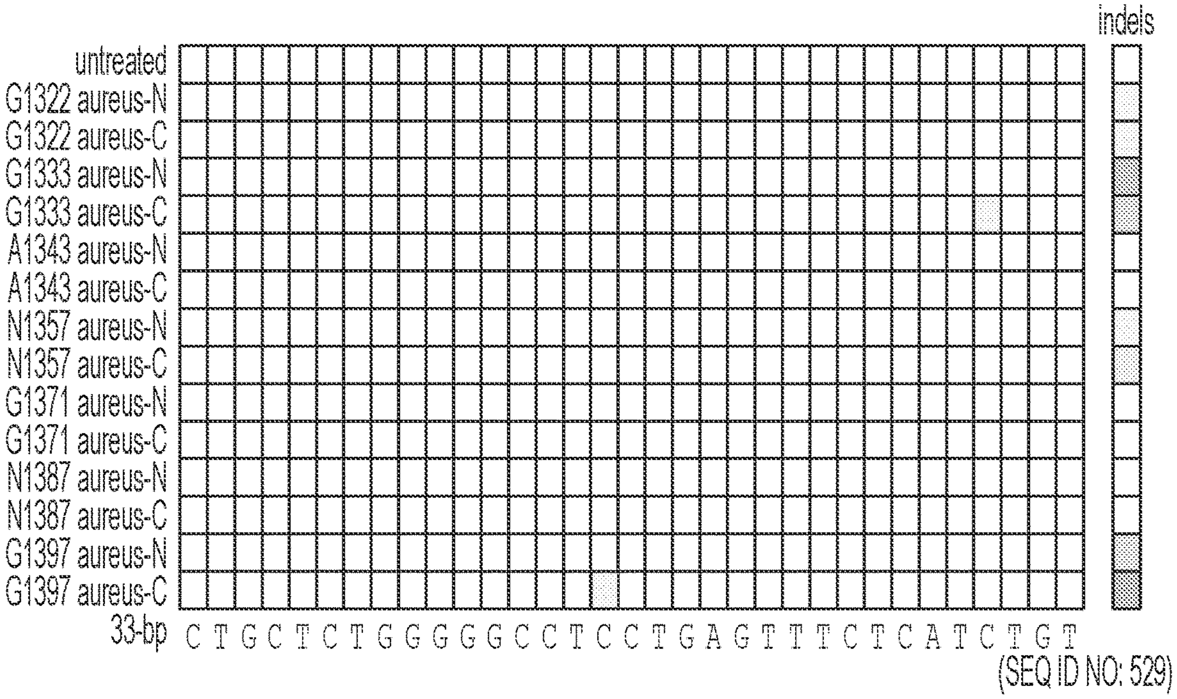
Figure 32F:
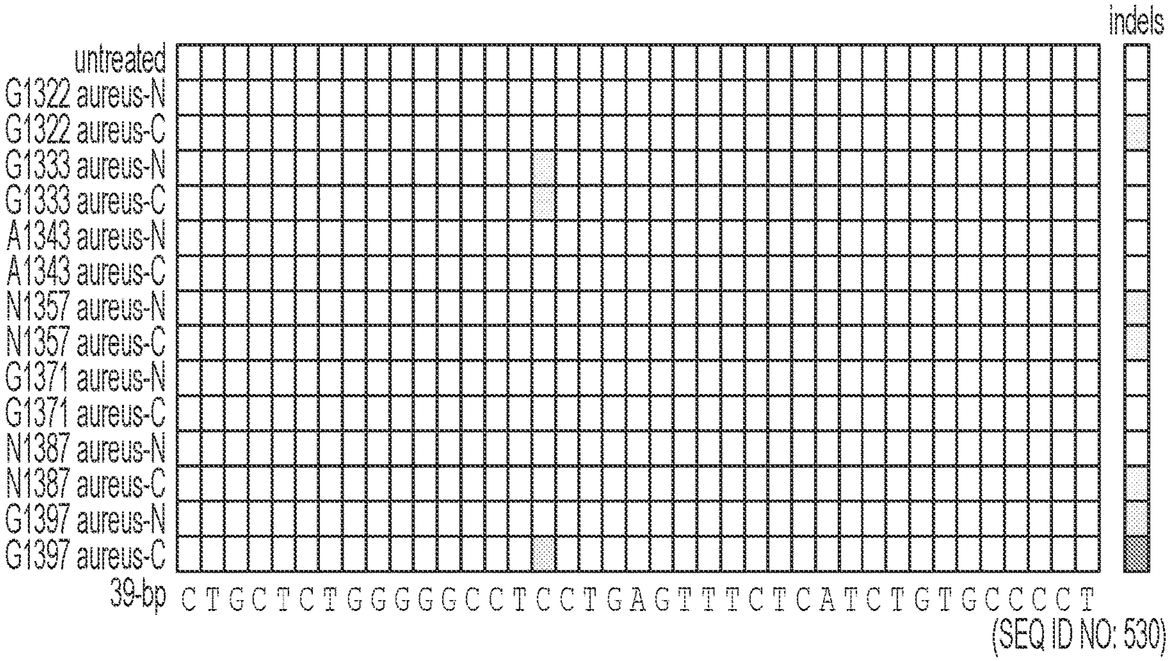
Figure 32G:
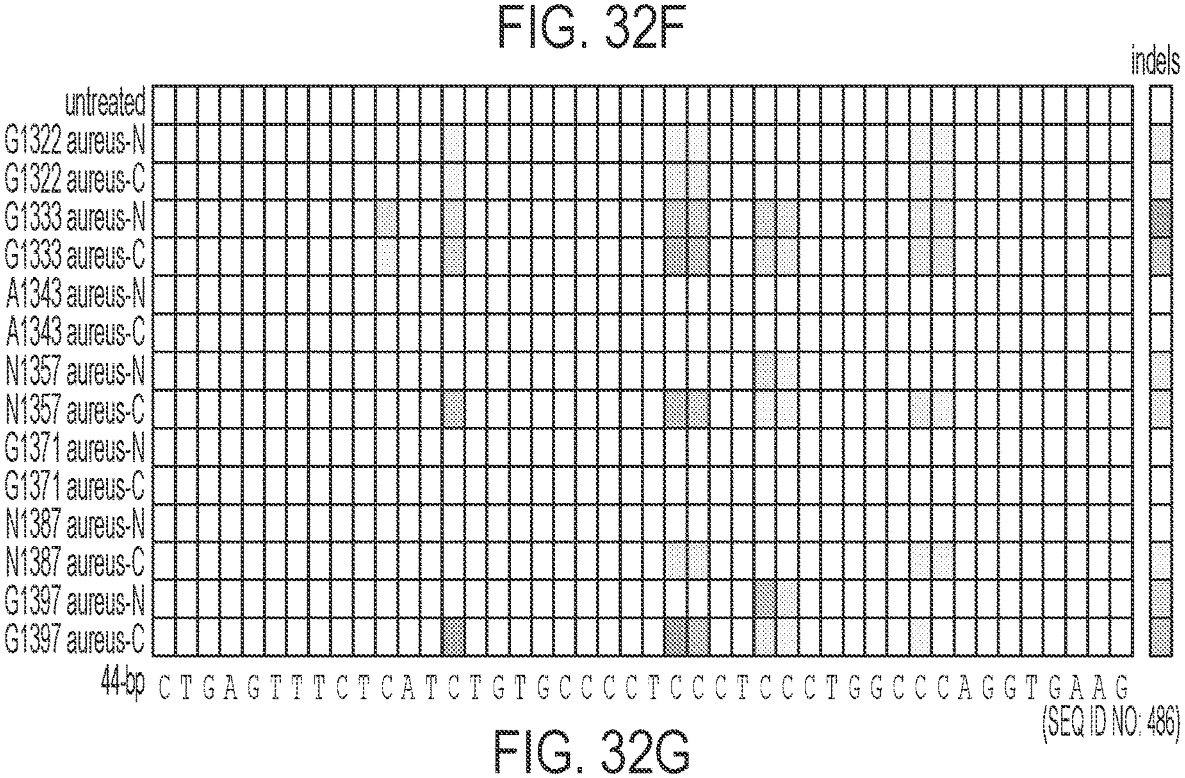
Figure 32H:
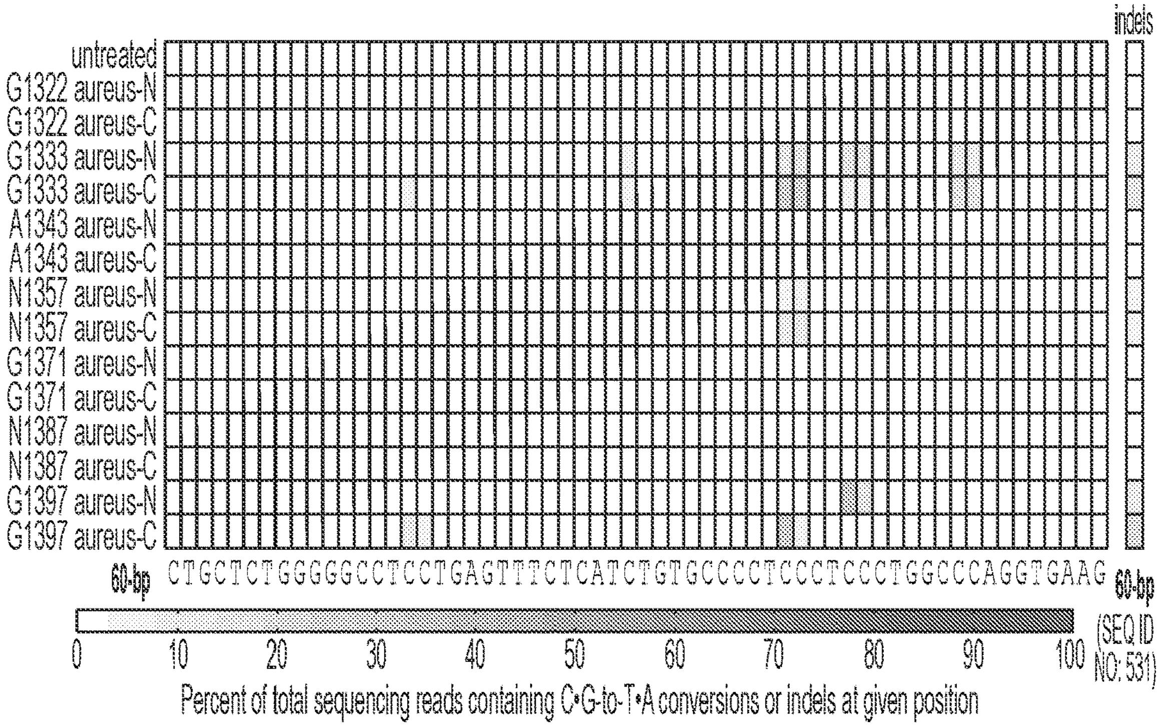

FIGS. 32A-32H show base editing efficiencies of all seven DddAtox splits. Each split was assayed in the aureus-N and aureus-C orientation (see FIG. 24B) across spacing region lengths of 12-bp (FIG. 32A), 17-bp (FIG. 32B). 23-bp (FIG. 32C), 28-bp (FIG. 32D), 33-bp (FIG. 32E), 39-bp (FIG. 32F), 44-bp (FIG. 32G) and 60-bp (FIG. 32H). Cytidines that are deaminated by reassembled $DddA_{tox}$ are represented on the heat map. At nucleotide positions containing a canonical T, indels can result in <100% T, as reflected on the heat map. Colors reflect the mean of n=2 independent biological replicates.

Figure 33A:
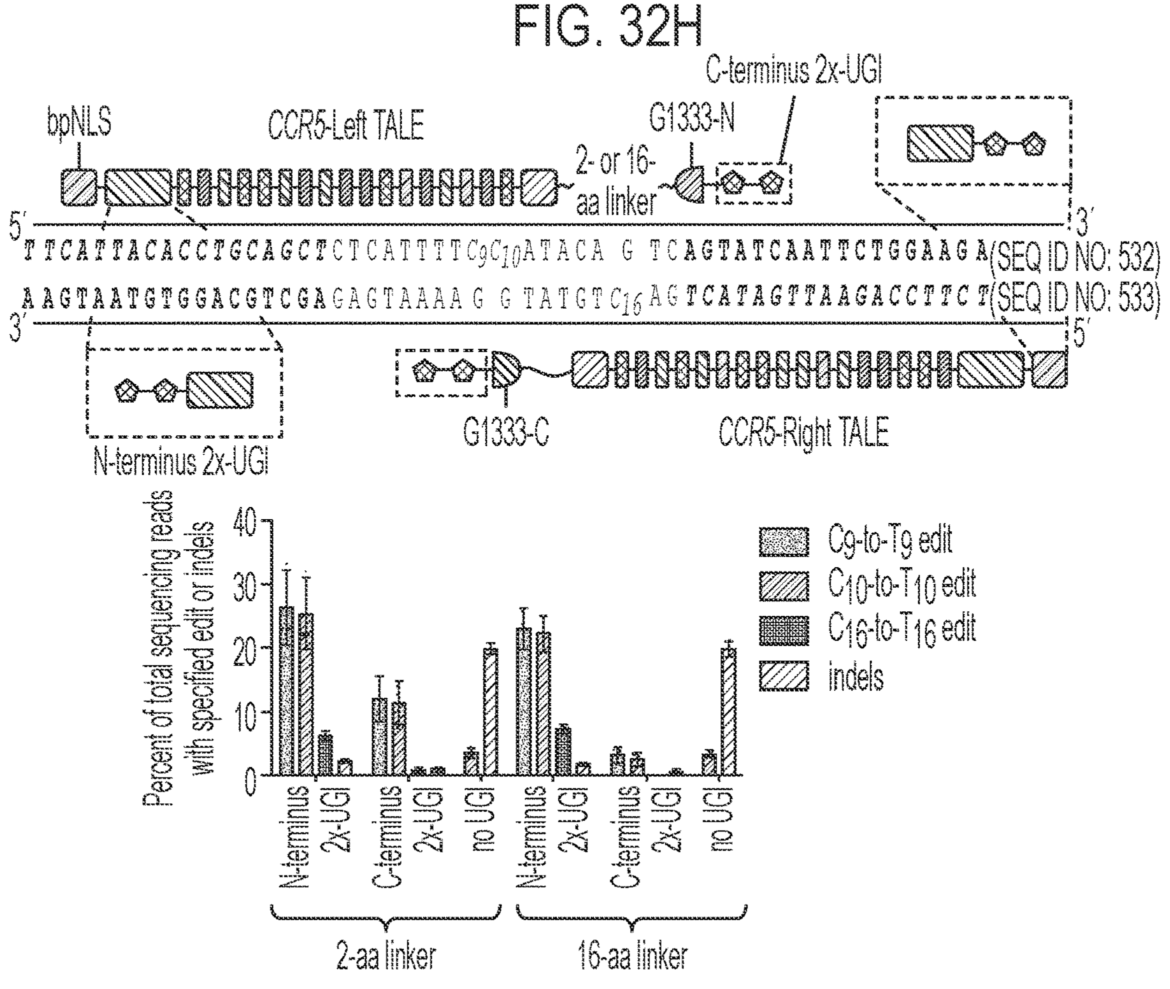
Figure 33B:
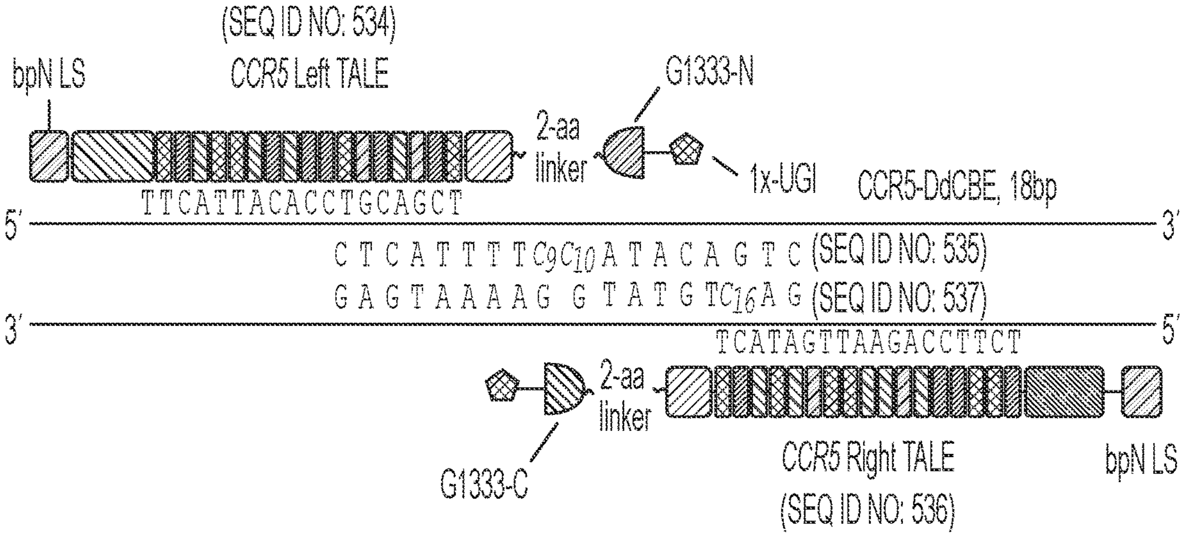
Figure 33C:
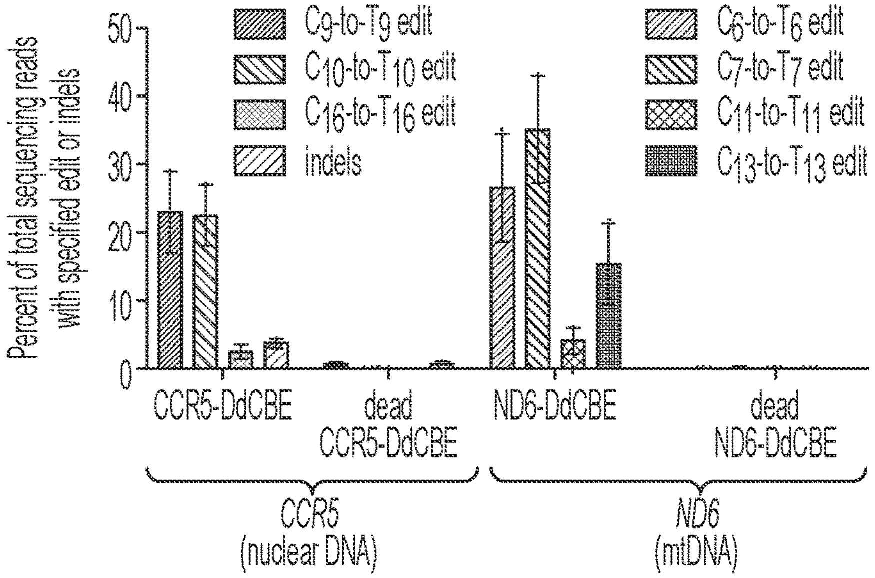
Figure 33D:
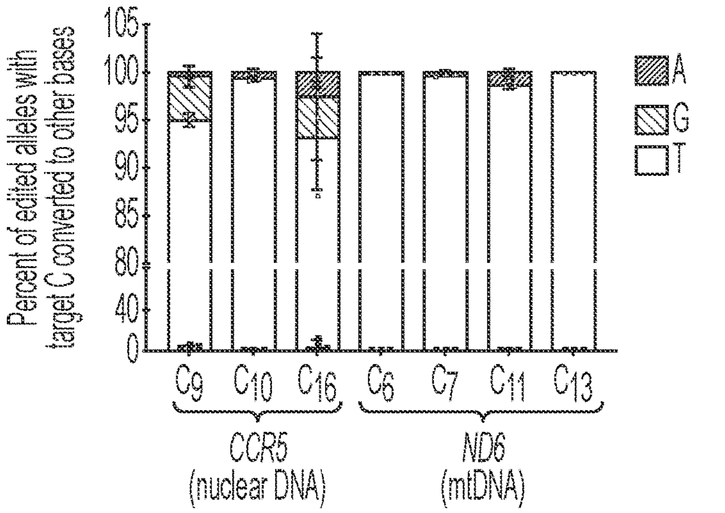

FIGS. 33A-33D show how TALE-split-$DddA_{tox}$ proteins mediate efficient base editing in nuclear DNA of human cells. FIG. 33A is a schematic of TALE-split $DddA_{tox}$ fusion variants that bind to DNA flanking the 18-bp spacing region at the nuclear CCR5 site in U20S cells. The target C is shown in C9, C10, and C16 and TALE binding sites are shown as nucleotides 1-11 of the top strand as read 5' to 3', and nucleotides 1-12 of the bottom strand as read 5' to 3'. Editing efficiencies and indel frequencies for TALE-split-$DddA_{tox}$ pairs in G1333 and G1397 split orientations are shown. FIG. 33B shows the architecture of CCR5-DdCBE. This architecture was optimized for DdCBEs targeting mtDNA. Target cytidines within the CCR5 spacing region are shown. FIG. 33C shows the editing efficiencies and indel frequencies of U20S cells treated with CCR5-DdCBE and ND6-DdCBE are shown. Dead-DdCBEs containing the inactivating $DddA_{tox}$(E1347A) mutation were used as negative controls. Cells were harvested 3 days-post transfection for DNA sequencing. FIG. 33D shows the outcomes among edited alleles in which the specified target C is mutated are shown for indicated base editor. Values and error bars in FIGS. 33A, 33C, and 33D reflect the mean±s.d. of n=3 independent biological replicates.

Figure 34A:
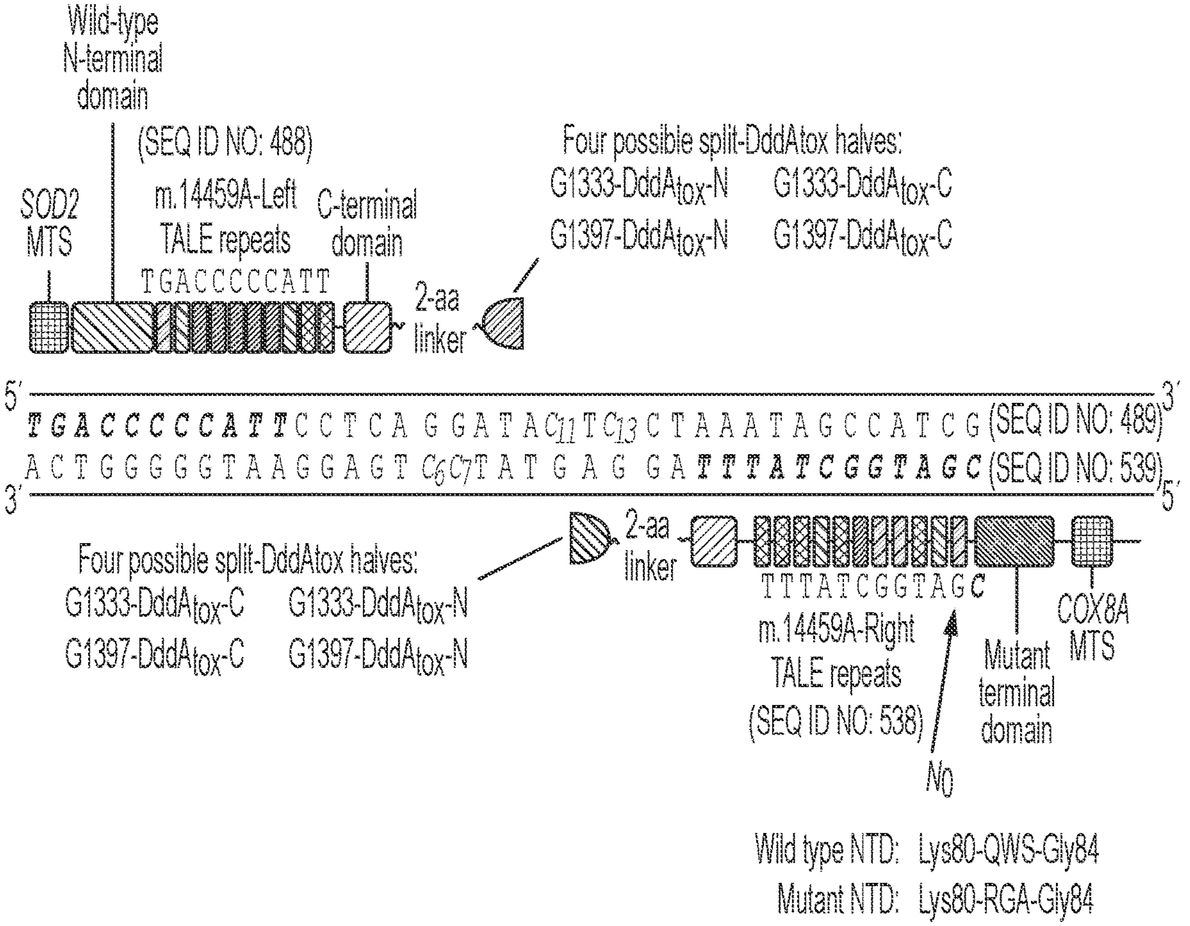
Figure 34B:
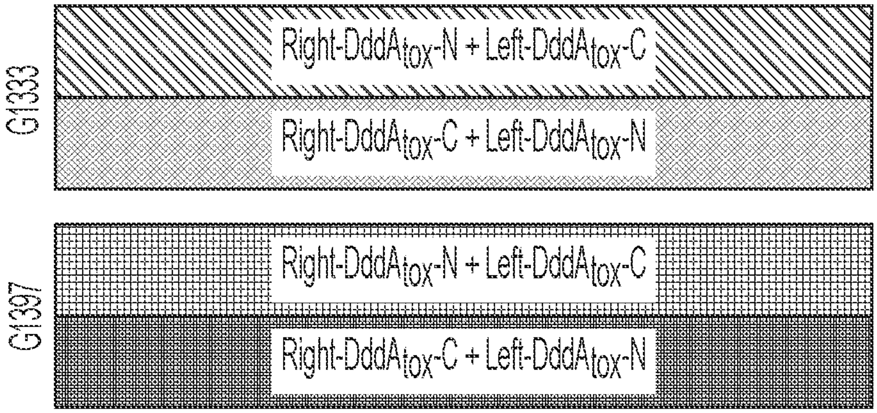
Figure 34C:
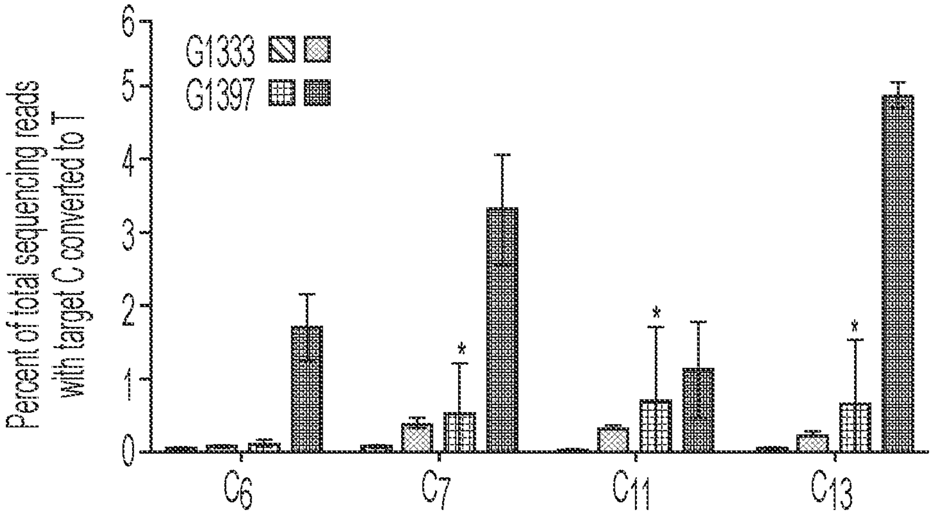
Figure 35A:
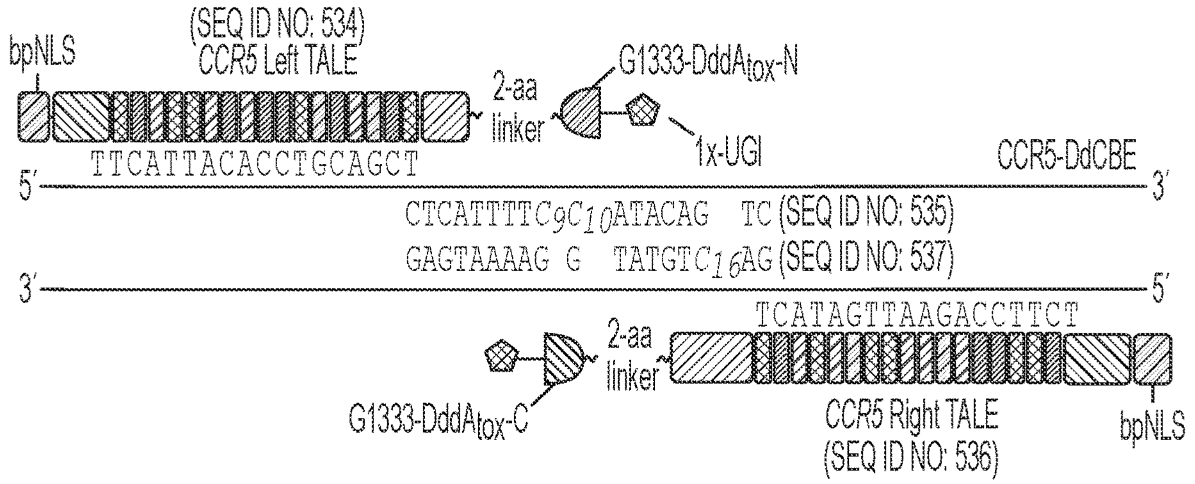
Figure 35B:
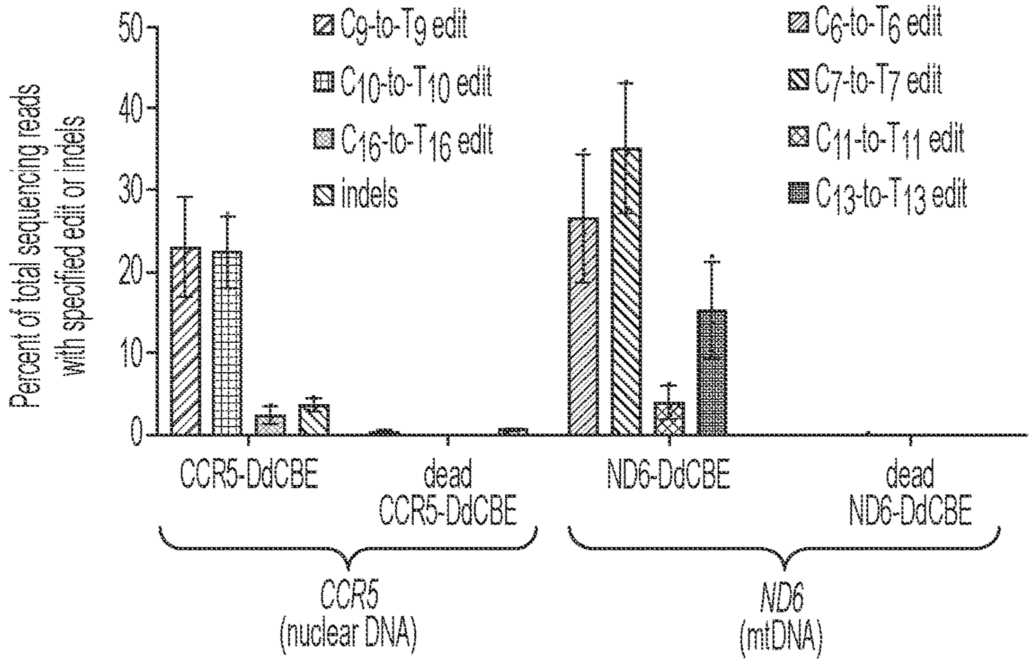
Figure 35C:
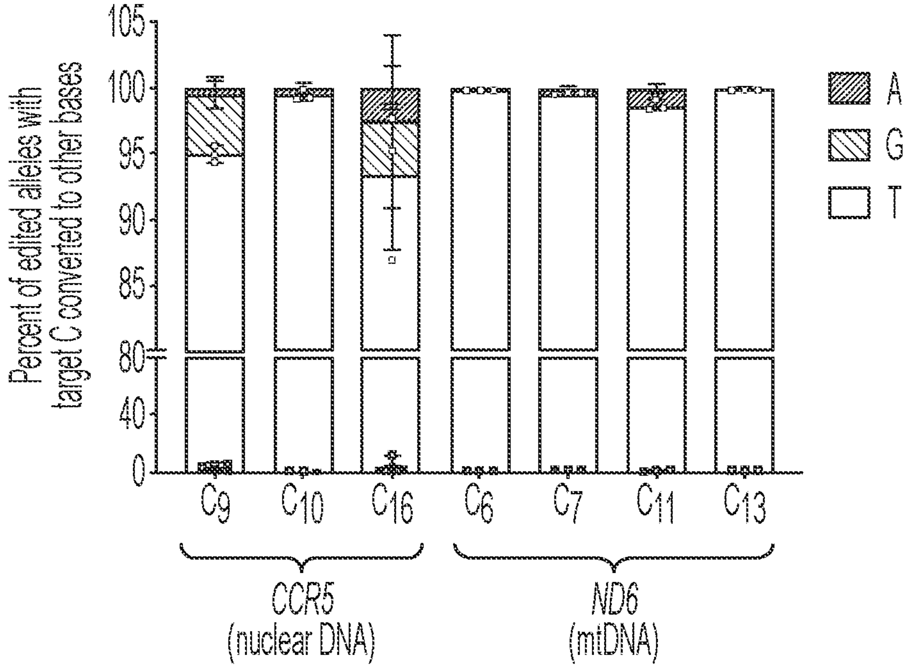

FIGS. 34A-34C show unoptimized mitoTALE-split $DddA_{tox}$ fusions mediate modest editing of mitochondrial ND6 in HEK293T cells. FIG. 34A shows the architectures of non-UGI containing ND6-mitoTALE-$DddA_{tox}$ fusion pair. $DddA_{tox}$ was split at G1333 or G1397. TALEs bind to mtDNA sequences (blue) that flank a 15-bp spacing region in mitochondrial ND6. Mutations in the N-terminal domain (NTD)[71] of the Right-TALE should permit recognition of C in addition to canonical T at the first nucleotide bound by the TALE array (the NO position). Target cytidines are shown in purple. The last TALE repeat marked with an asterisk did not match the reference genome (see Supplementary Table 4). FIG. 34B shows mtDNA editing efficiencies of mitoTALE-$DddA_{tox}$ pairs in the listed split orientations. The dashed line is drawn at 0.1%. FIG. 34C zmLOC100282174, a *Zea mays*-derived MTS's, was appended before or after SOD2 and COX8A MTS sequence of each MTS-mitoTALE-split $DddA_{tox}$-UGI fusion. All editing efficiencies are measured 3 days post-transfection. Values and error bars in FIGS. 34B and 34C reflect the mean±s.d. of n=3 independent biological replicates FIGS. 35A-35C show how DdCBE editing in the nucleus of U20S cells yields more indels and lower product purity compared to editing in the mitochondria. FIG. 35A Architecture of CCR5-DdCBE. DddAtox was split at G1333 with DddAtox-N fused to the left-side CCR5-targeting TALE (see FIG. 33A for editing efficiencies of other split orientations in the absence of UGI protein). The bpNLS sequence directs the localization of the CCR5-targeting DdCBE to the nucleus. Target cytidines within the CCR5 spacing region are shown in C9, C10, ad C16. FIG. 35B shows editing efficiencies and indel frequencies of U20S cells treated with CCR5-DdCBE and ND6-DdCBE are shown. The inactive mutant DdCBEs (dead-DdCBE) containing DddAtox (EI347A) were used as negative controls. FIG. 35C shows product purity among edited DNA sequencing reads in which the specified target C is mutated is shown for nuclear CCR5-DdCBE and mitochondrial ND6-DdCBE. All values and errors in (FIG. 35B) and (FIG. 35C) reflect the mean±s.d. of n=3 independent biological replicates.

Figure 36A:
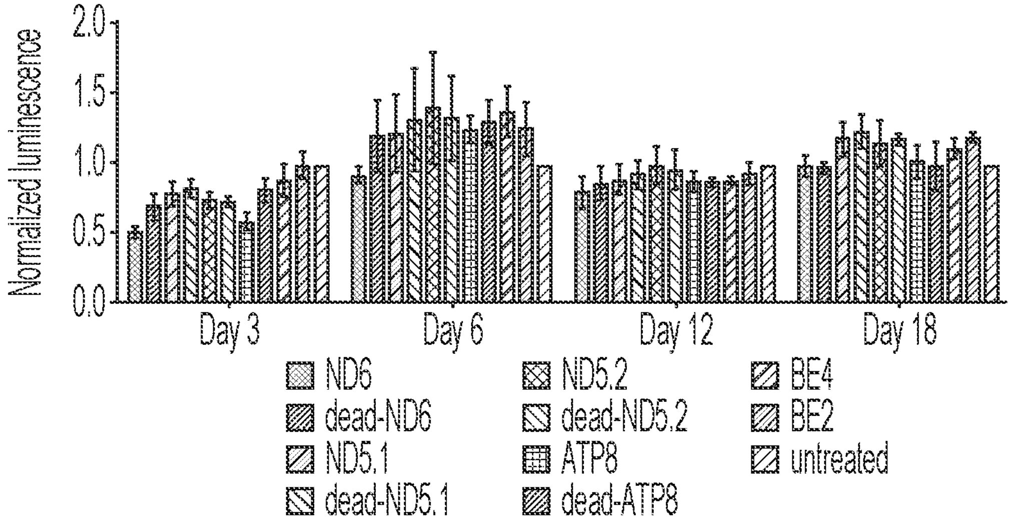
Figure 36B:
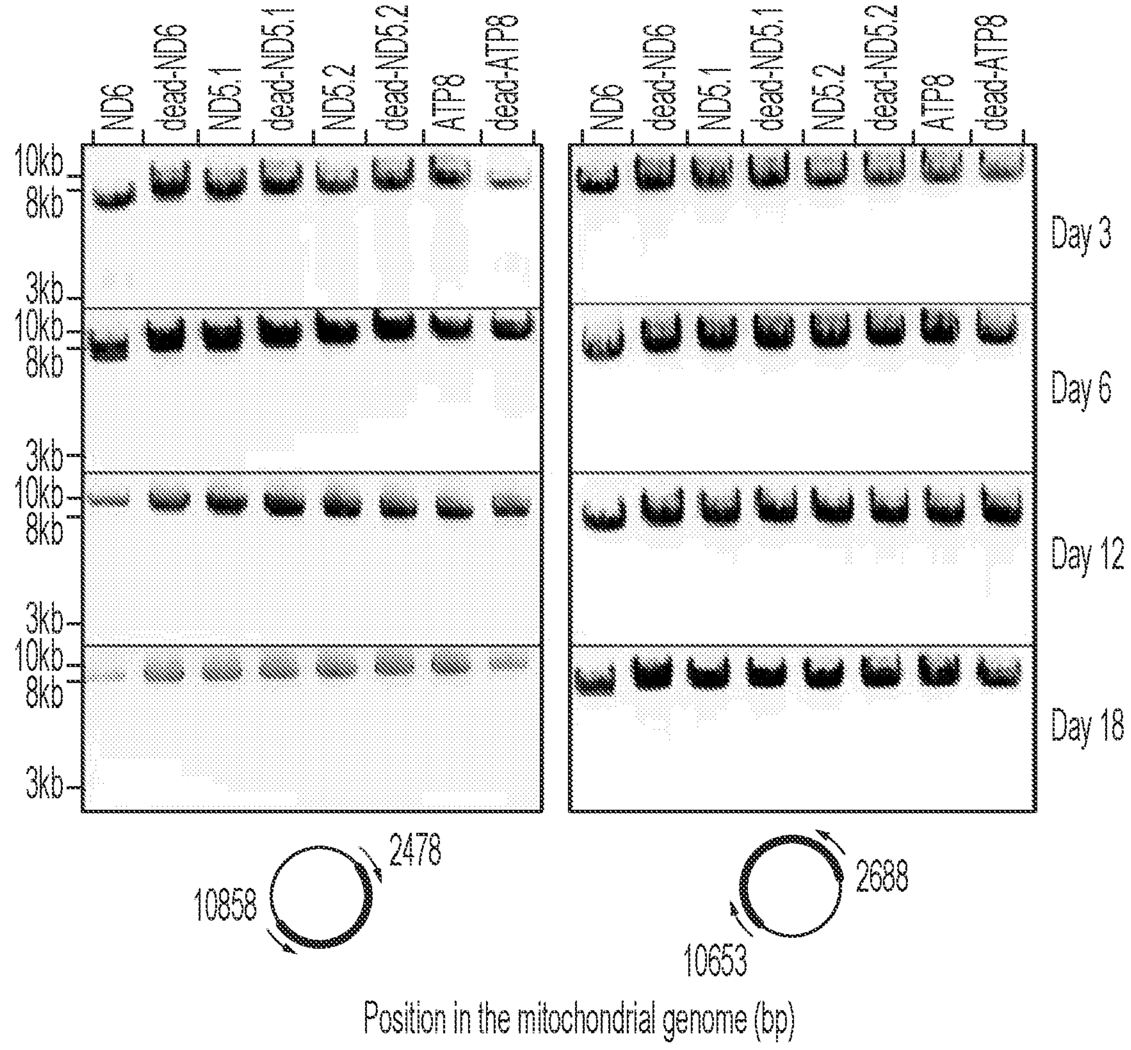
Figure 36C:
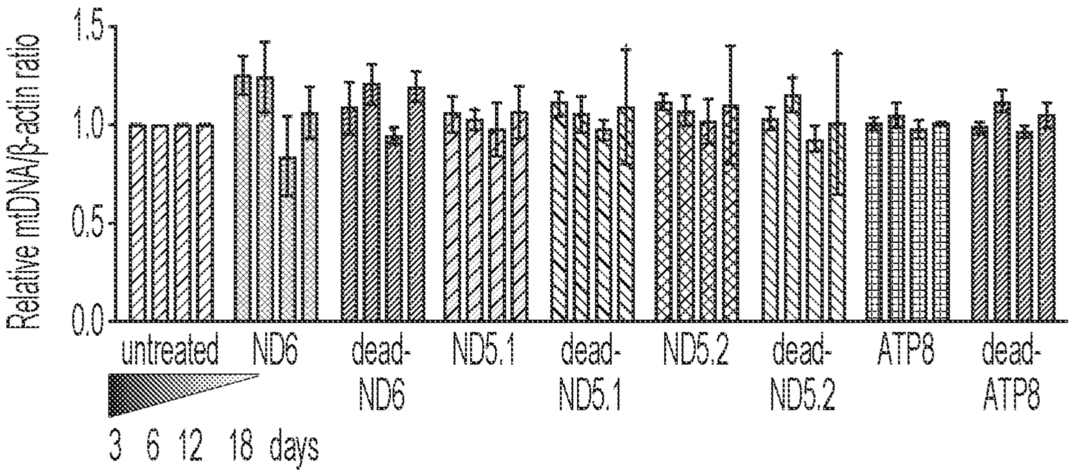

FIGS. 36A-36C show the effect of DdCBE editing on cell viability and mitochondrial DNA integrity. FIG. 36A shows cell viability was measured by luminescence at indicated timepoints using the CELLTITER-GLO® 2.0 assay (Promega). Luminescence values were normalized to untreated control. FIG. 36B shows that purified genomic DNA was isolated from DdCBE-treated HEK293T cells at indicated timepoints and amplified by PCR with mtDNA-specific primers to capture the entire 16.6 kb mtDNA as two amplicons (shown between the arrows as bounded by the tails). DNA gel images are representative of n=3 independent biological replicates (see FIG. 51 for uncropped images). FIG. 36C shows relative mtDNA levels in cells treated with indicated DdCBE were measured by quantitative PCR at various timepoints (see the Supplementary Sequences section of Example 1 for PCR primers). All values and errors in (FIG. 36A) and (FIG. 36C) reflect the mean±s.d of n=3 independent biological replicates.

Figure 37A:
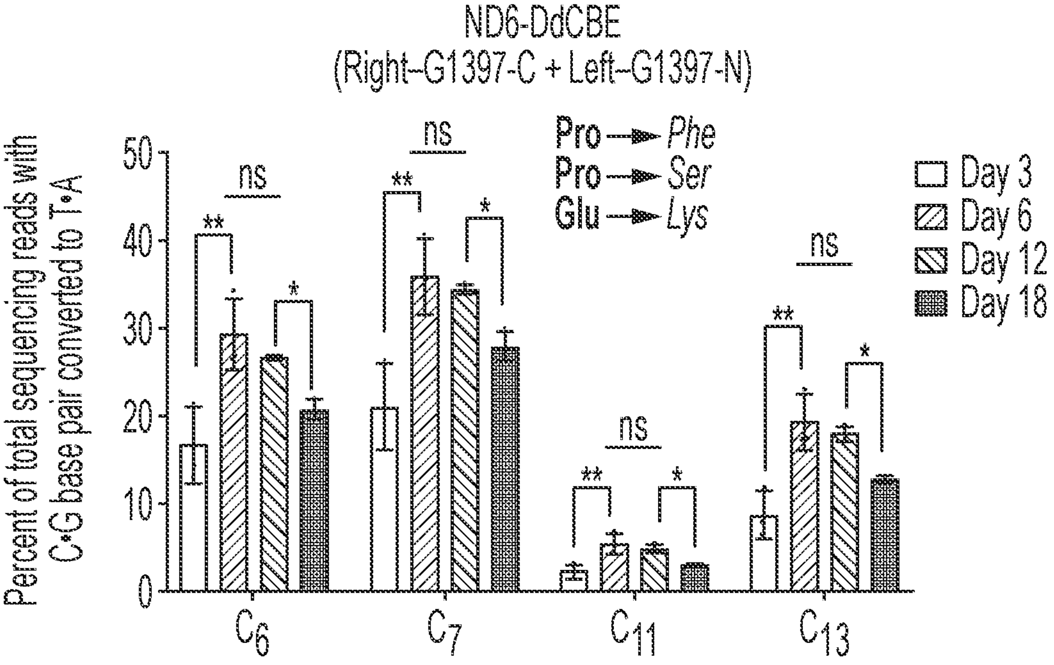
Figure 37B:
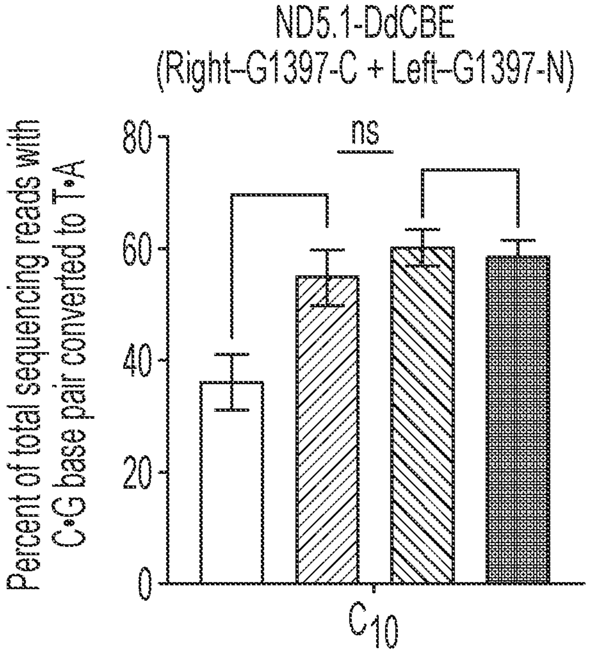
Figure 37C:
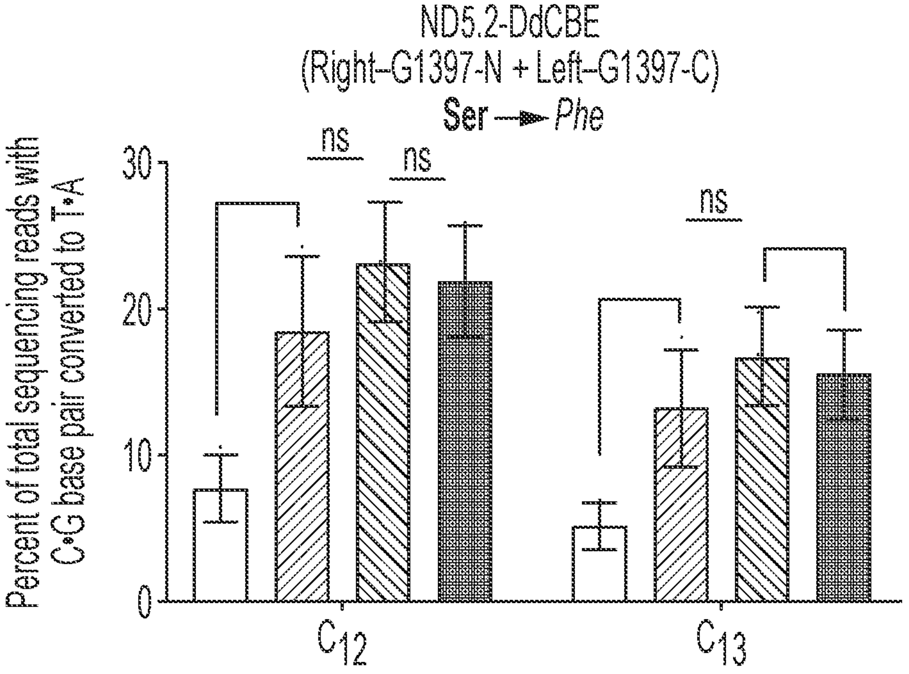
Figure 37D:
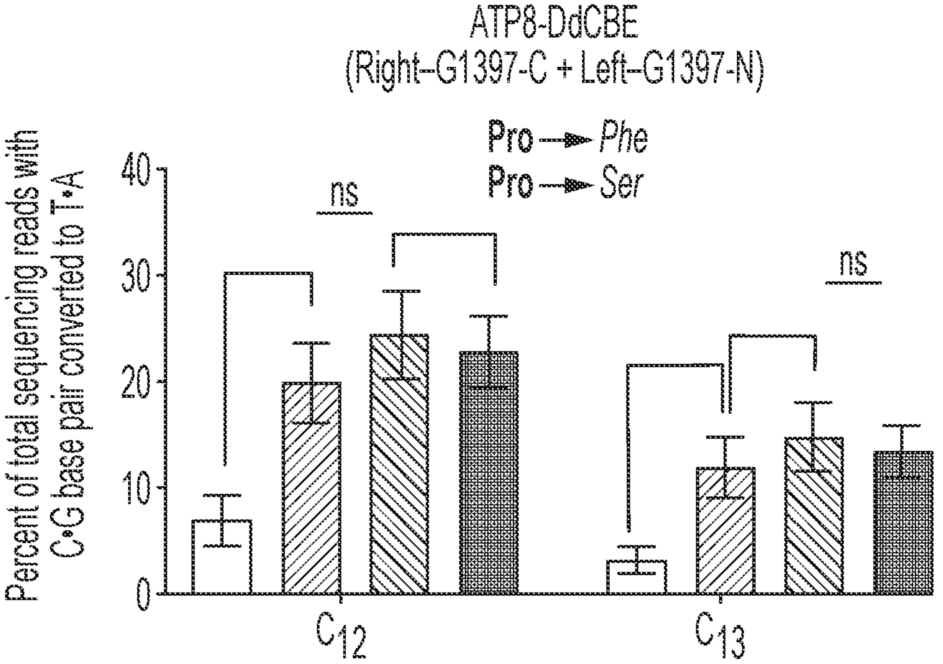
Figure 37E:
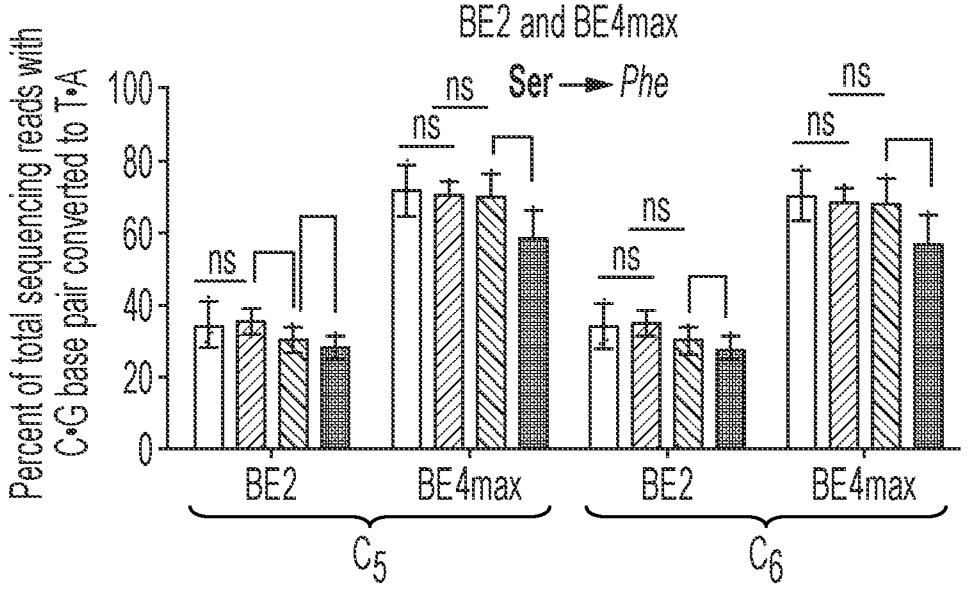
Figure 37F:
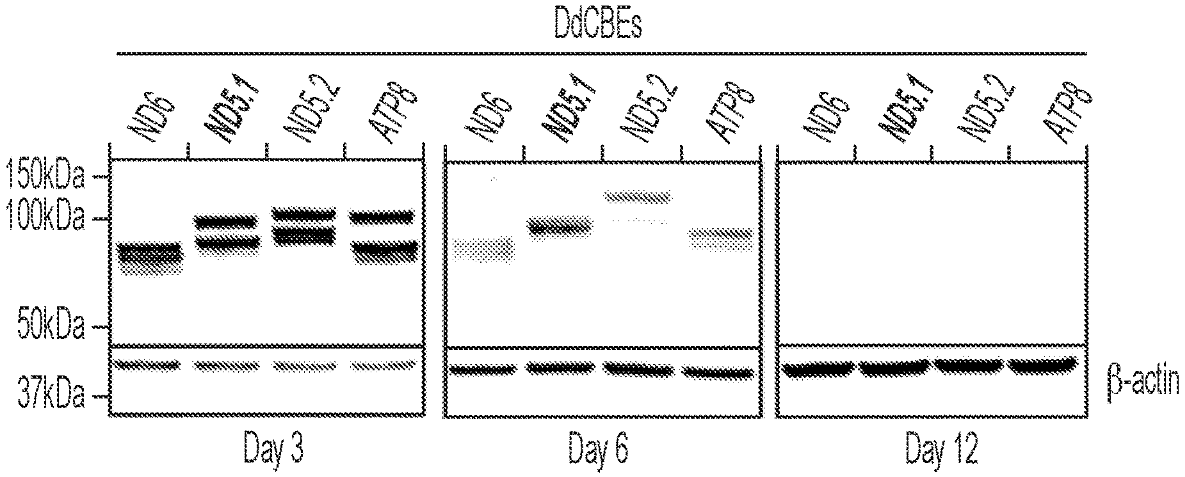

FIGS. 37A-37F show that targeted DdCBE editing in mtDNA of HEK293T cells persist over multiple cell divisions. Editing efficiencies for ND6-DdCBE (FIG. 37A), ND5.1-DdCBE (FIG. 37B), ND5.2-DdCBE (FIG. 37C), ATP-DdCBE (FIG. 37D), BE2 and BE4max (FIG. 37E) in HEK293T cells are shown for each timepoint. For each DdCBE (FIGS. 37A-37D), the optimized split orientation is listed in parenthesis. C•G-to-T•A conversions at protein-coding genes that generate missense mutations (first amino acid as read left to right, shown at the tail-end of each arrow) of the putative amino acid (second amino acid as read left to right, shown at the head of each arrow) are shown. All values and errors reflect the mean±s.d. of n=3 independent biological replicates. For (FIGS. 37A-37E), asterisks indicate significant editing based on a comparison between indicated time points. *P<0.05 and **P<0.01 by Student's two-tailed paired t-test. Individual P values are listed in Table 3. FIG. 37F shows a western blot of ND6-, ND5.1-. ND5.2-, and ATP8-DdCBE at various timepoints from crude HEK293T cell lysates. The right halves were FLAG-tagged and the left halves were HA-tagged. DdCBE halves are distinguished by their molecular weight (see FIG. 52 for uncropped images and fluorescent tagging of each half). Nuclear s-actin was used as loading control.

Figure 38B:
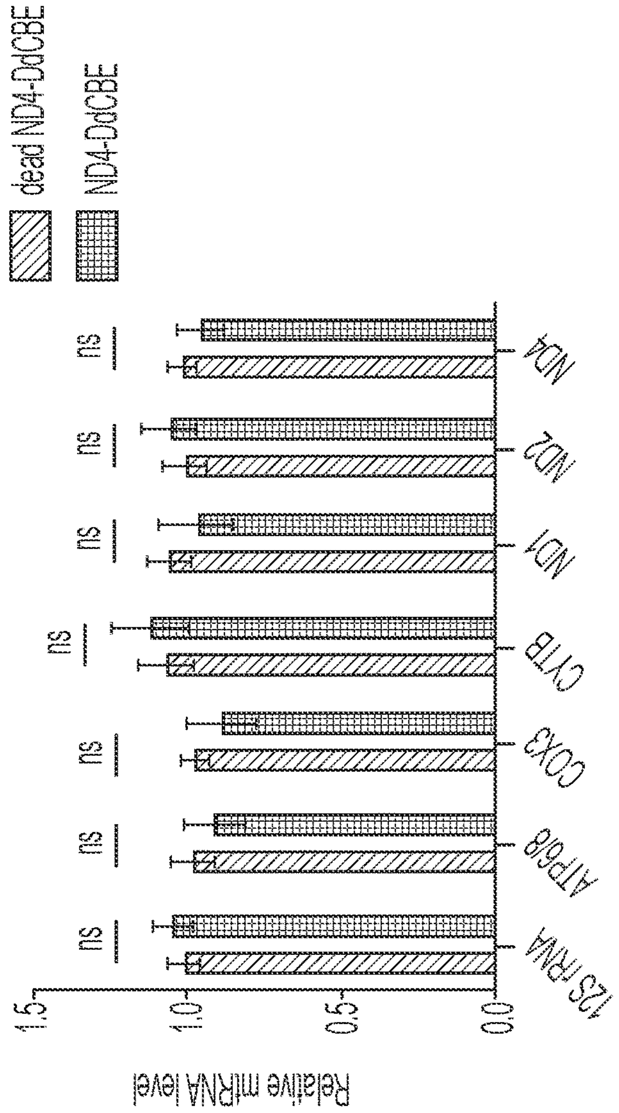
Figure 38A:
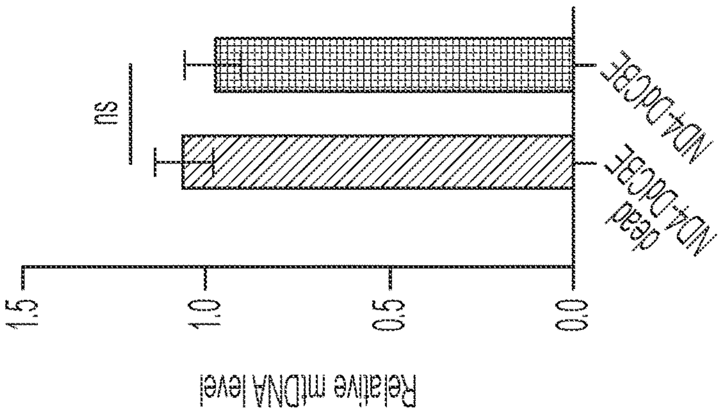
Figure 38C:
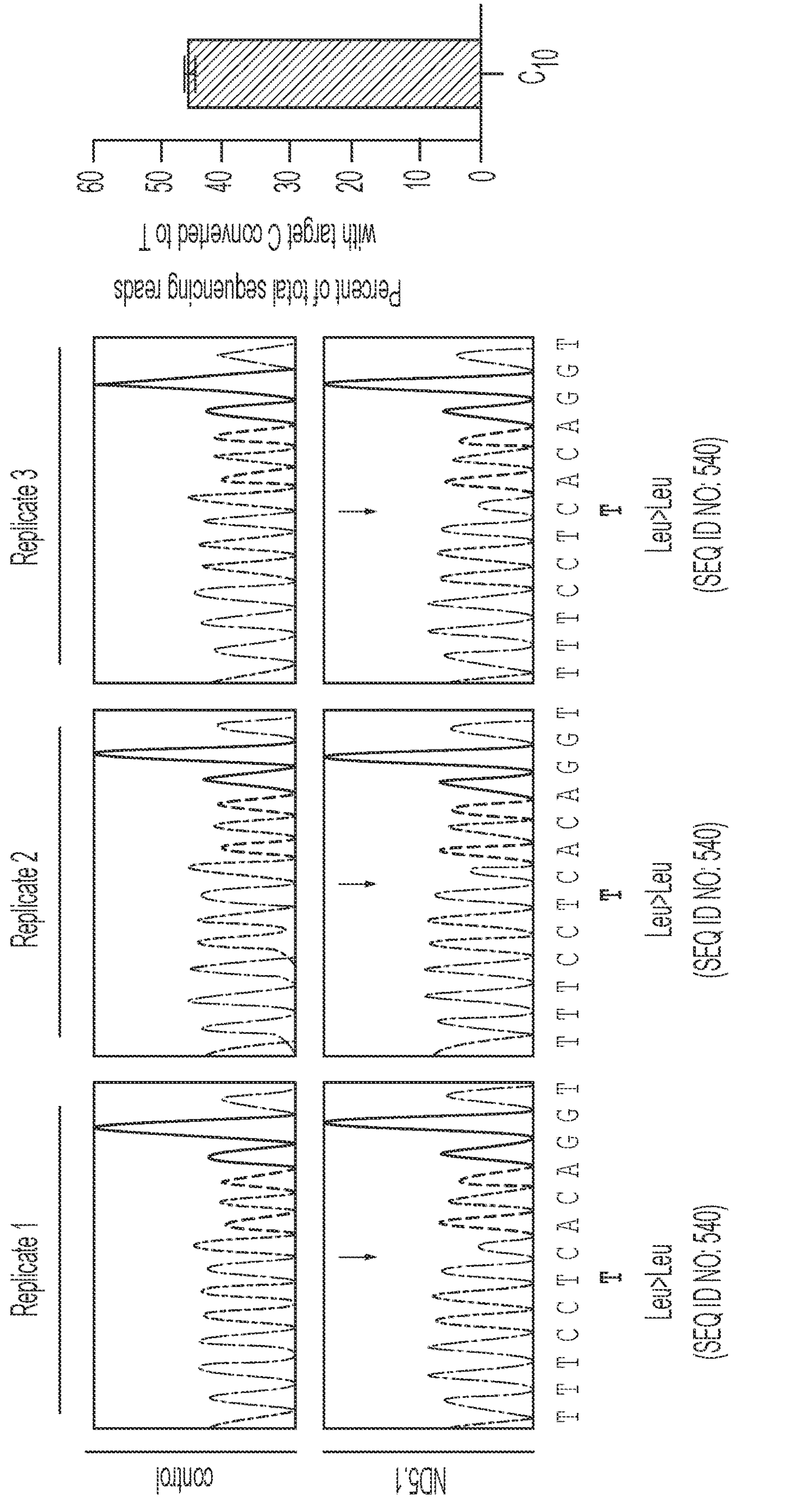
Figure 38E:
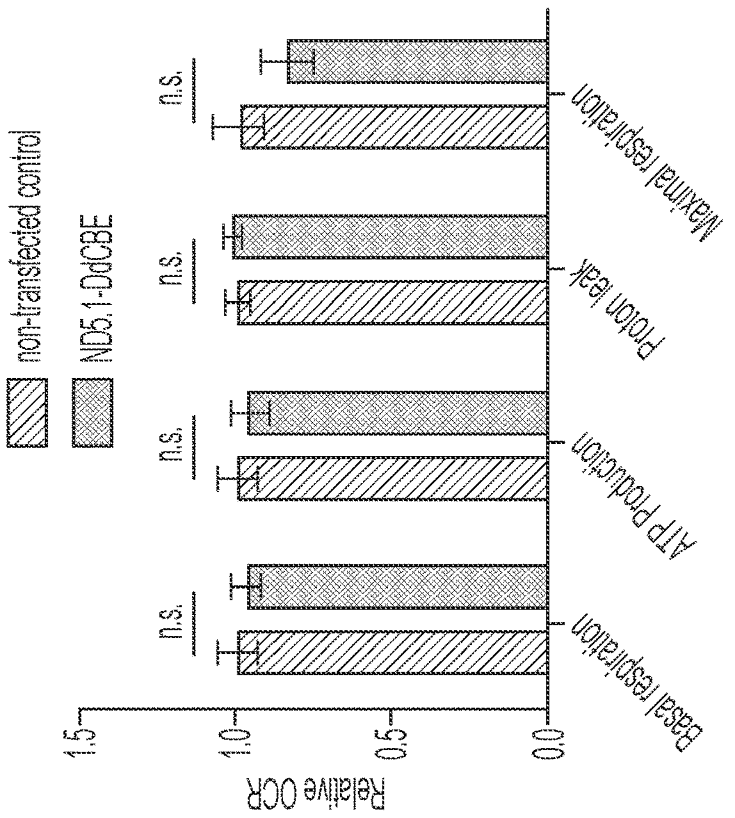
Figure 38D:
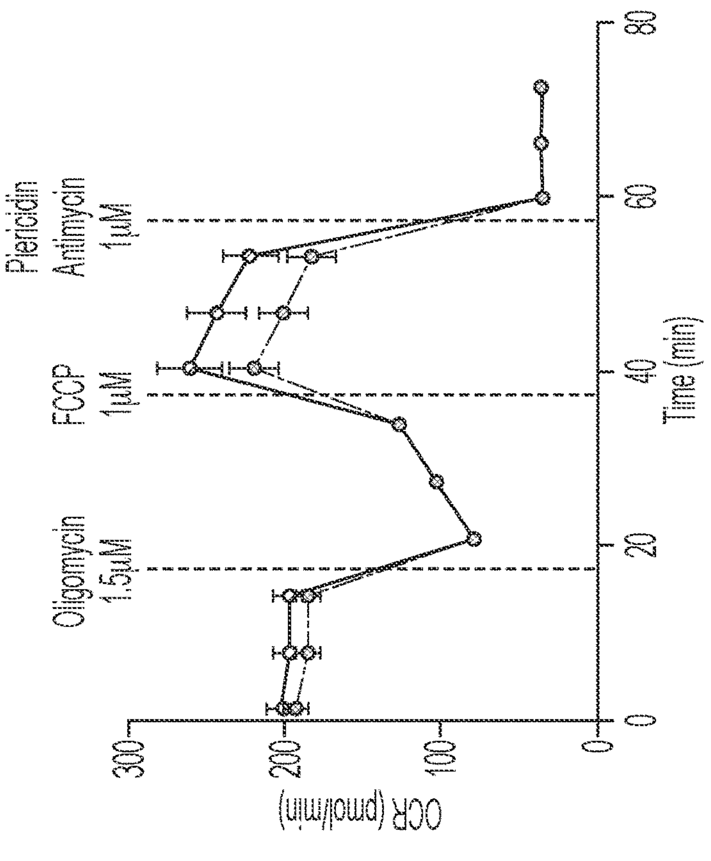
Figure 38F:
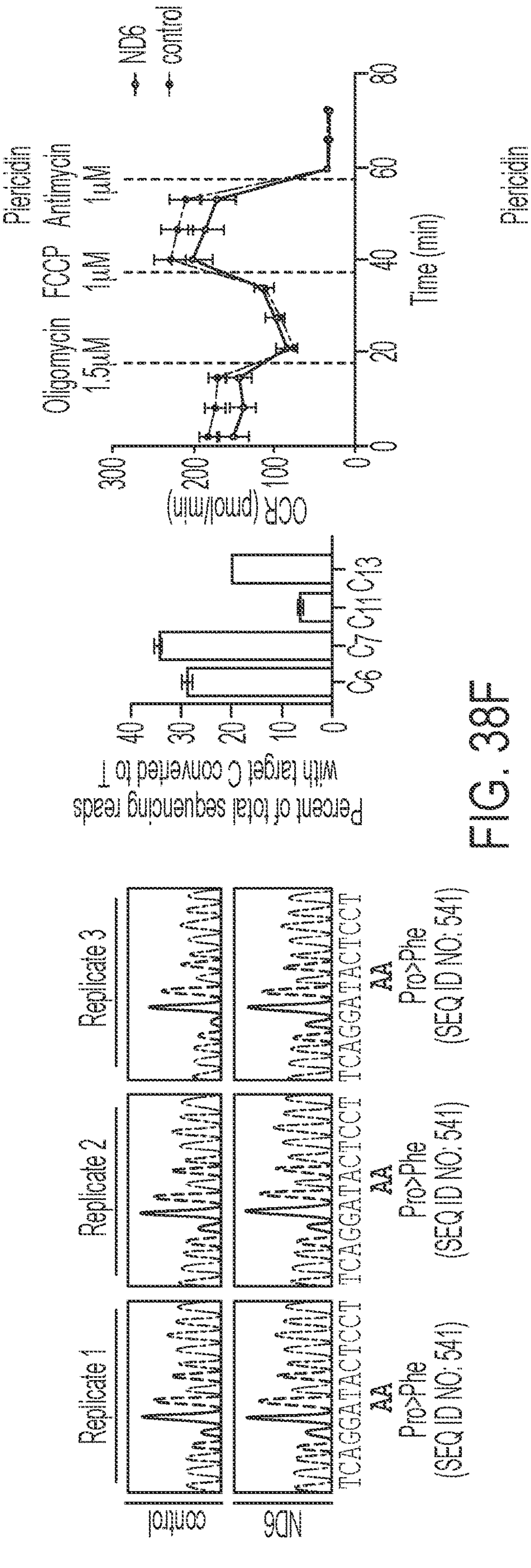
Figure 38G:
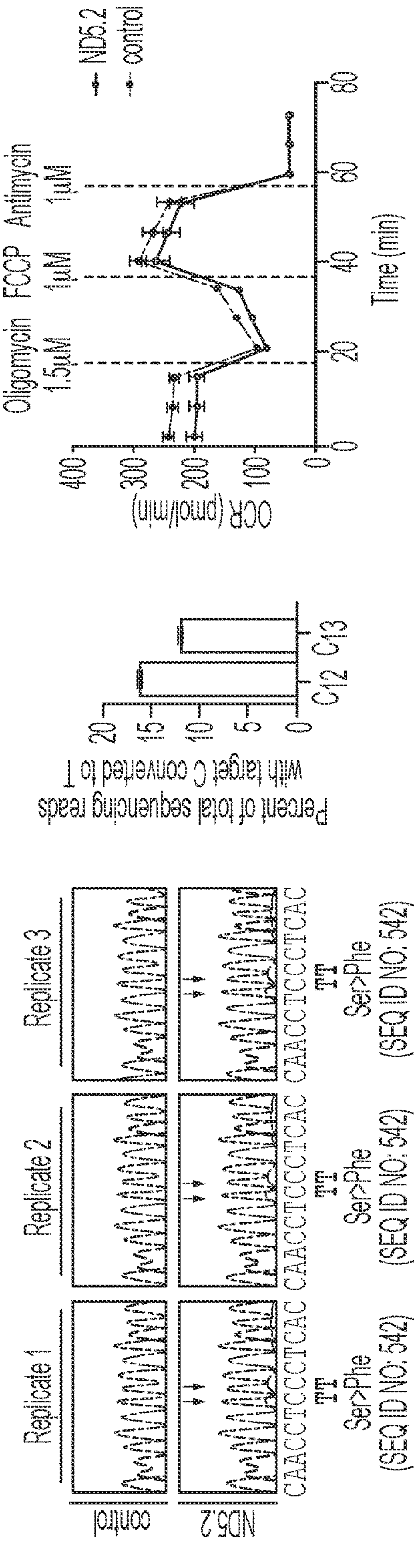
Figure 38H:
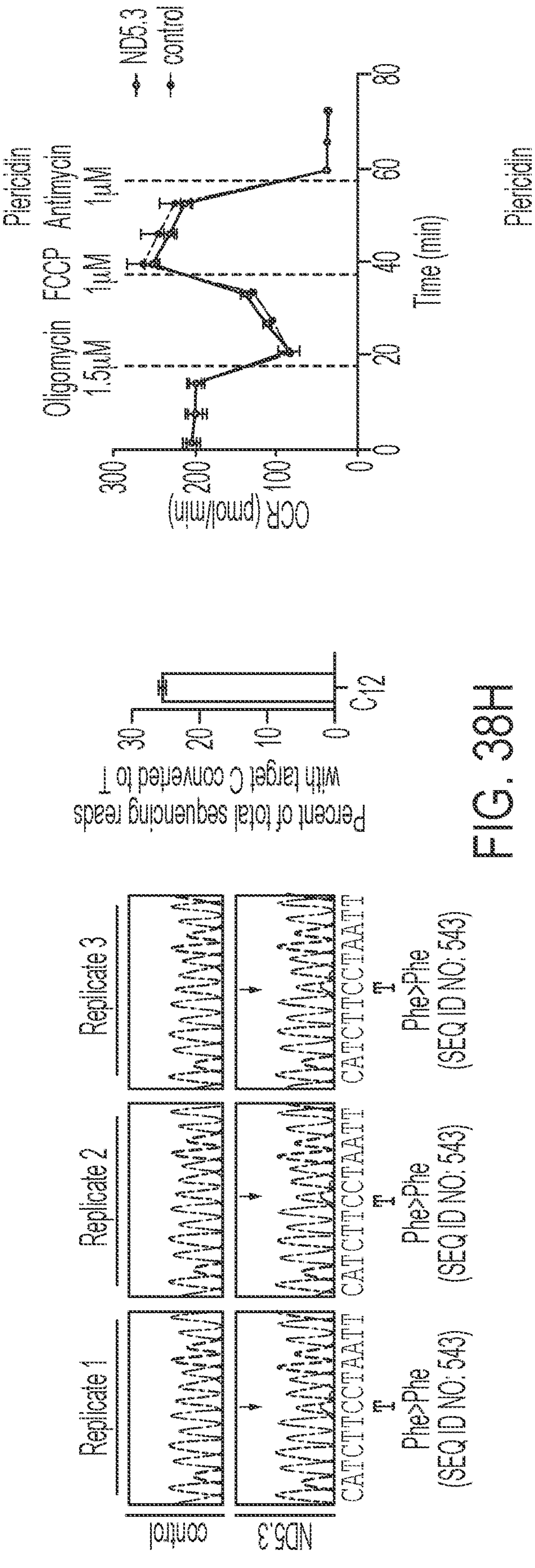
Figure 38I:
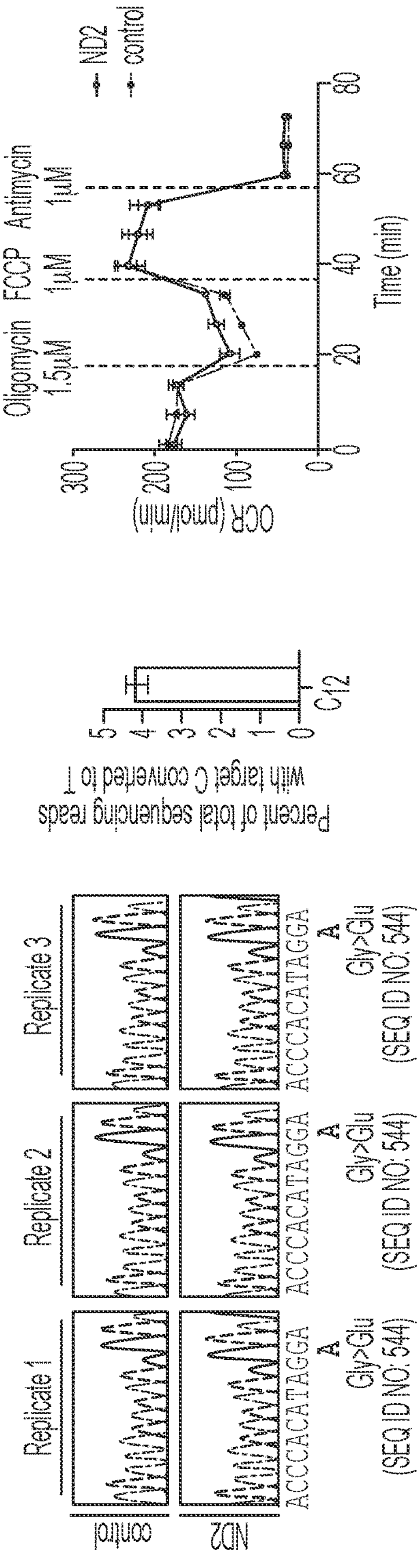
Figure 38J:
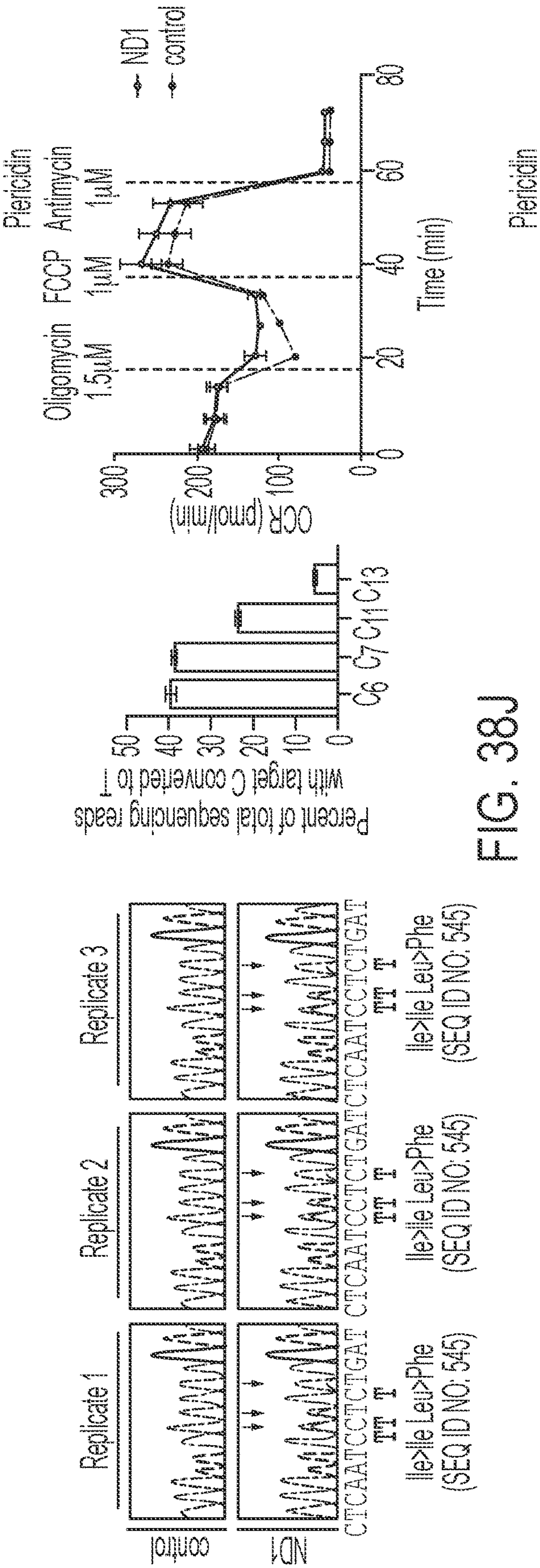
Figure 38K:
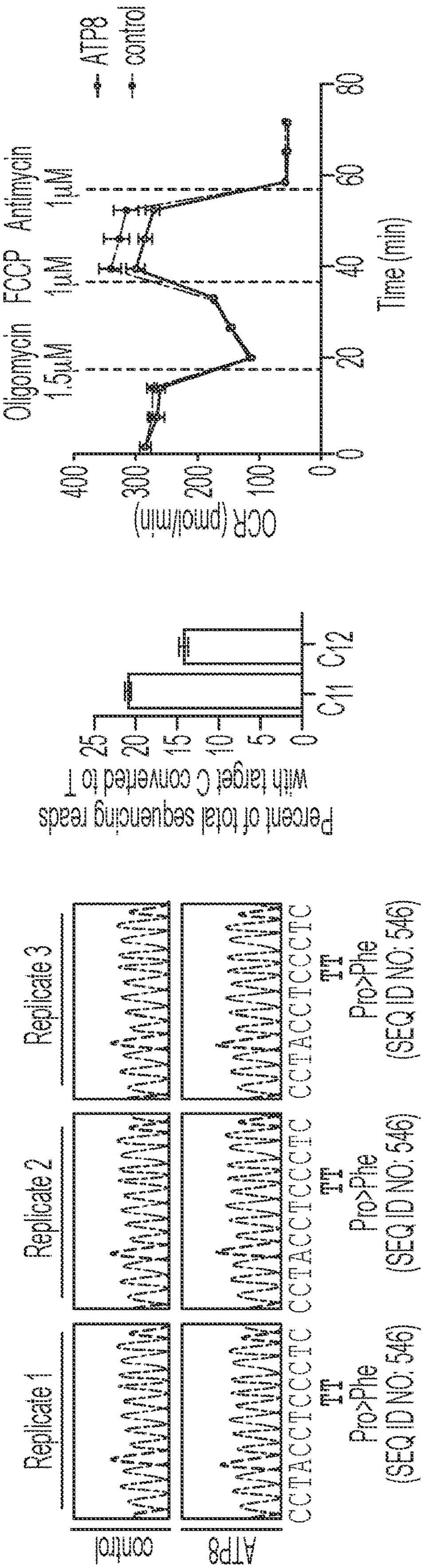

FIGS. 38A-38K show the effects of ND4-DdCBE editing on mtDNA homeostasis. FIG. 38A shows mtDNA levels of ND4-edited cells measured by quantitative PCR (qPCR) relative to mock-edited cells. FIG. 38B shows mtRNA levels of ND4-edited cells measured by RT-qPCR relative to mock-edited cells. All values and errors reflect the mean±SEM of n=3 independent biological replicates. Student's unpaired two-tailed t-test was applied, ns, not significant (P>0.05). FIG. 38C shows the confirmation of m.13494C>T ND5 editing by Sanger sequencing and Illumina DNA sequencing in cells transfected with ND5.1-

DdCBE. Non-transfected cells were used as a control. FIG. 38B shows the oxygen consumption rate (OCR) of cells treated with ND5.1-DdCBE. ND5.1-DdCBE; (left-hand column of each pair of columns) non-transfected control. FIG. 38C shows the relative values of respiratory parameters of ND5.1-DdCBE-treated cells. Sanger sequencing, Illumina DNA sequencing and OCR of cells treated with ND6-DdCBE (FIG. 38D), ND5.2-DdCBE (FIG. 38E), ND5.3-DdCBE (FIG. 38F), ND2-DdCBE (FIG. 38G), ND1-DdCBE (FIG. 38H) and ATP8-DdCBE (FIG. 38I) are shown. All cells were harvested 6 days post-transfection. All values and error bars shown in the graphs reflect the mean±SEM of n=3 independent biological. For (FIG. 38B) and (FIG. 38E), Student's unpaired two-tailed t-test was applied, ns, not significant (P>0.05).

Figure 39A:
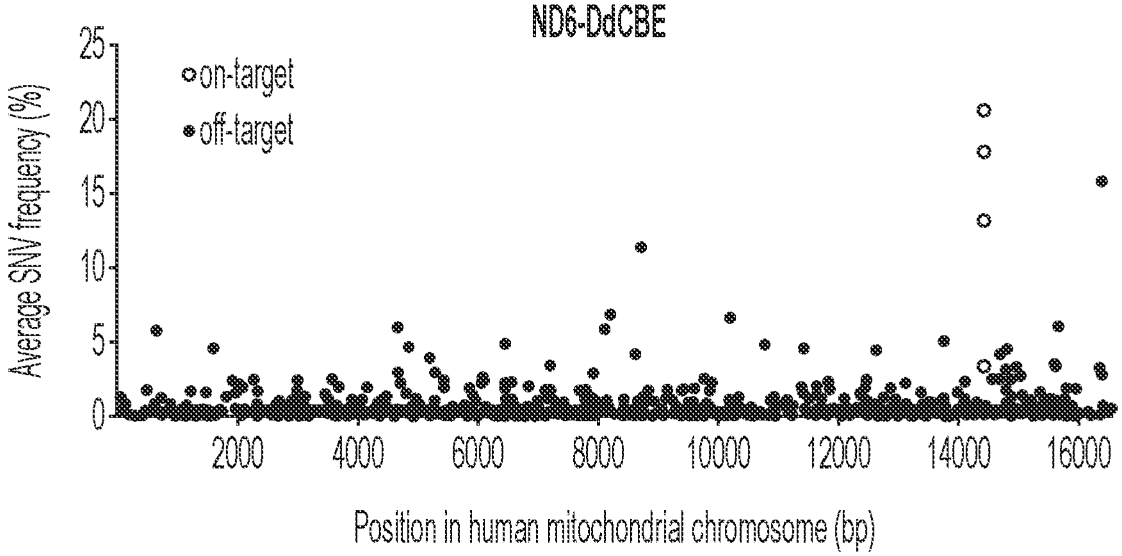
Figure 39B:
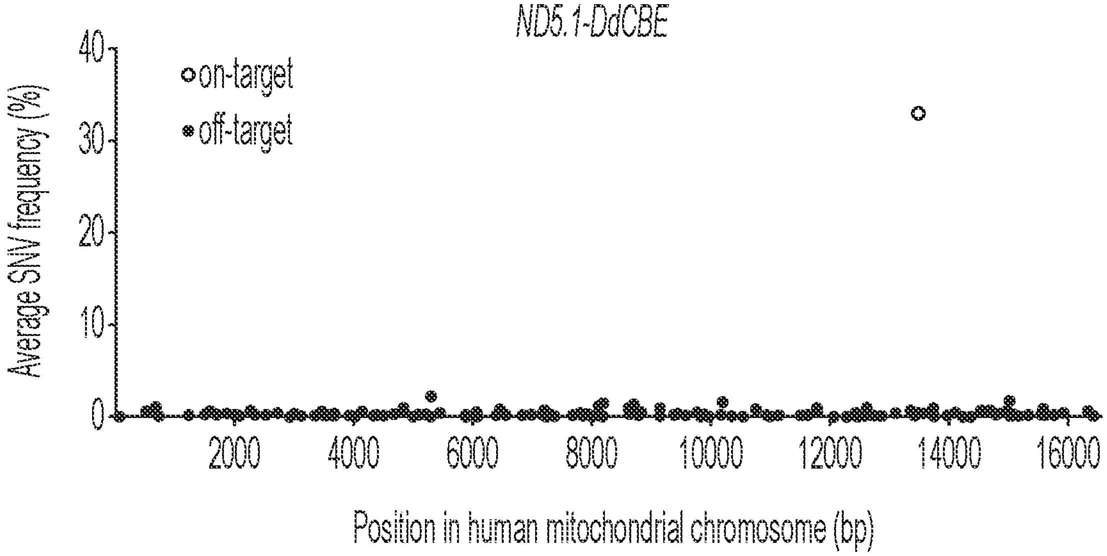
Figure 39C:
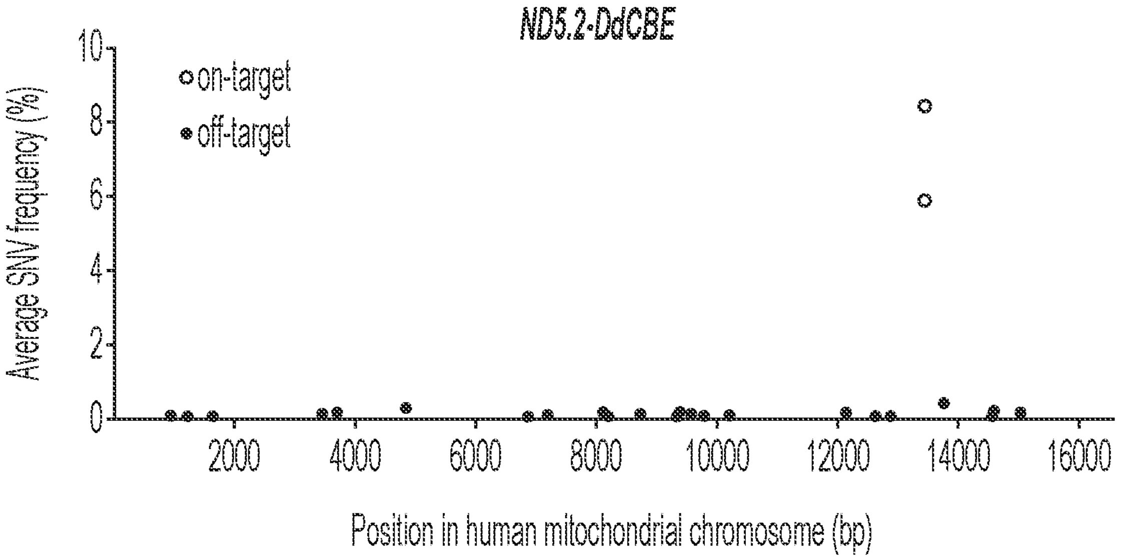
Figure 39D:
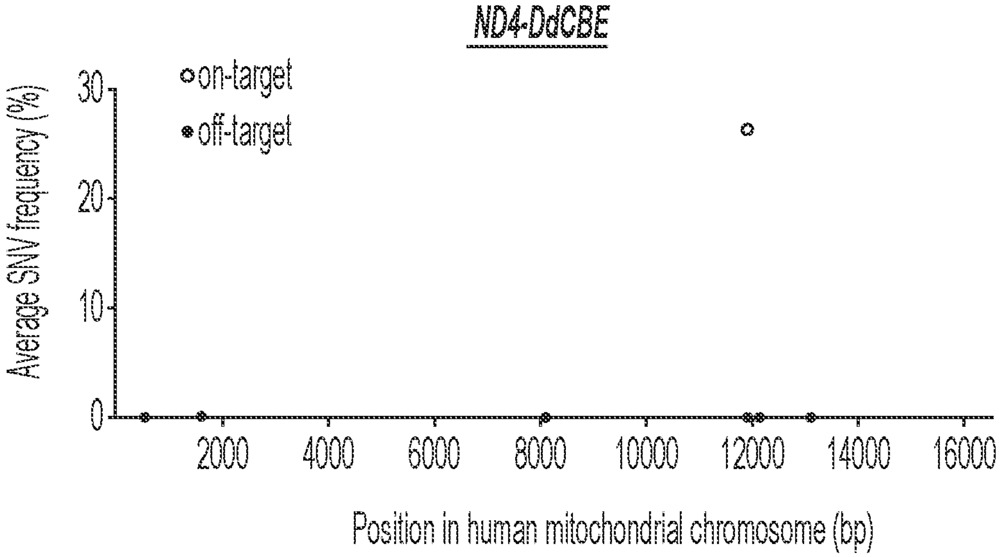
Figures 39E, 39F:
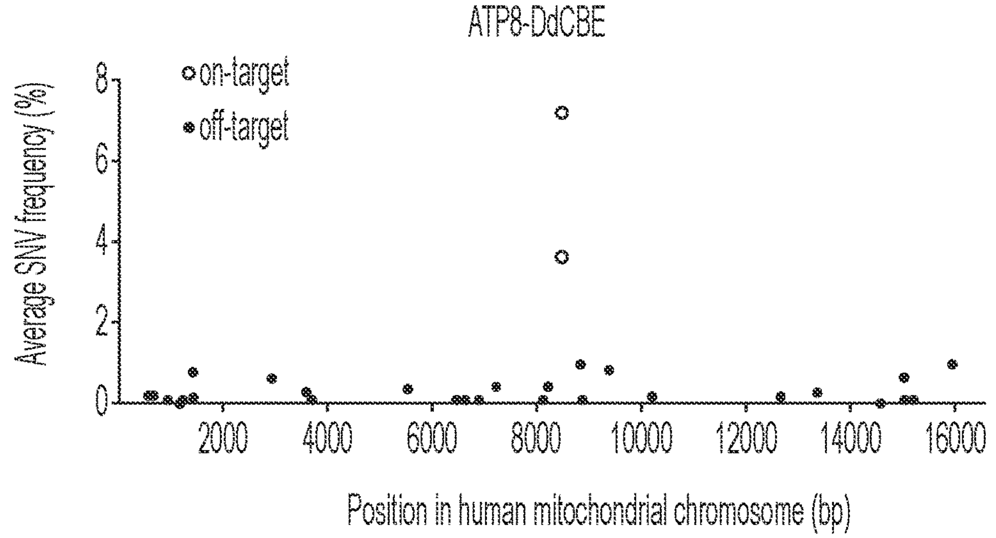

FIGS. 39A-39F show average frequencies of each on-target (colored) and off-target (grey) SNV and their positions within the NC_012920 reference human mtDNA are shown for 5,000-10,000 cells treated with ND6-DdCBE (FIG. 39A), ND5.1-DdCBE (FIG. 39B), ND5.2-DdCBE (FIG. 39C), ND4-DdCBE (FIG. 39D), or ATP8-DdCBE (FIG. 39E). FIG. 39F shows SNP alleles and their associated average frequencies are listed for the dead-DdCBEs, TALE-free G1397 DddAtox, and untreated controls. For (FIGS. 39A-39E), dead DdCBEs, and TALE-free G1397 DddAtox, the combined number of unique off-target SNVs from all three independent biological replicates that are absent in the untreated control are shown. For the untreated control, heteroplasmic mutations were excluded. Average frequencies were calculated from three independent biological replicates.

Figure 40A:
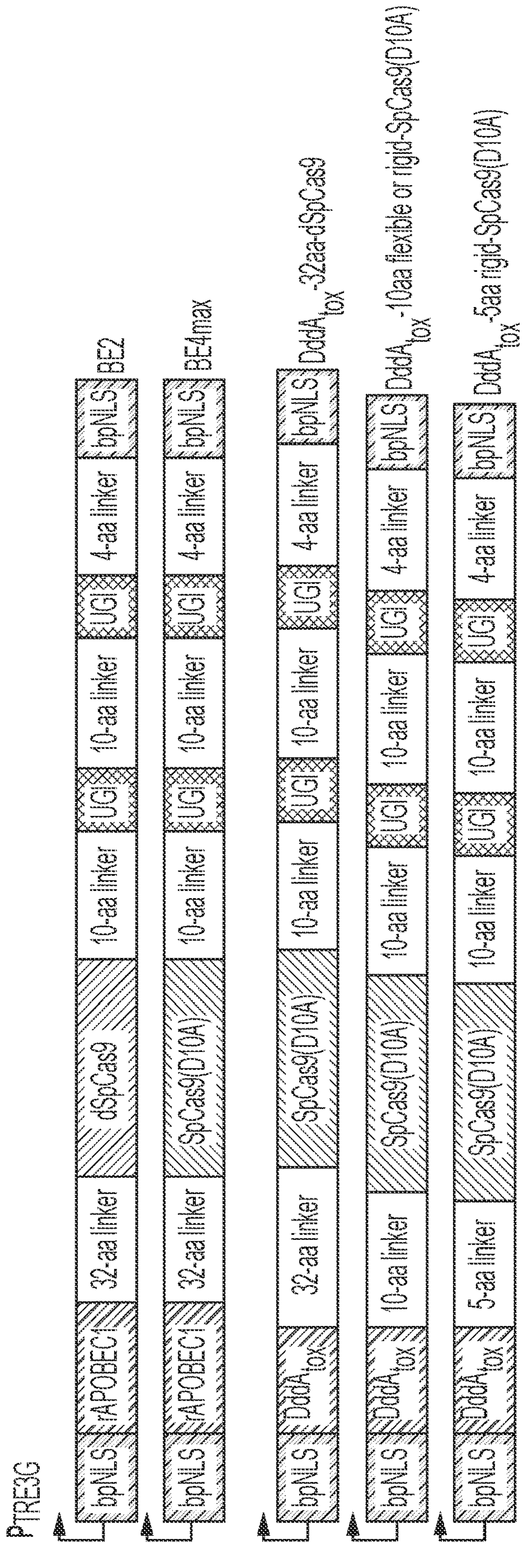
Figure 40B:
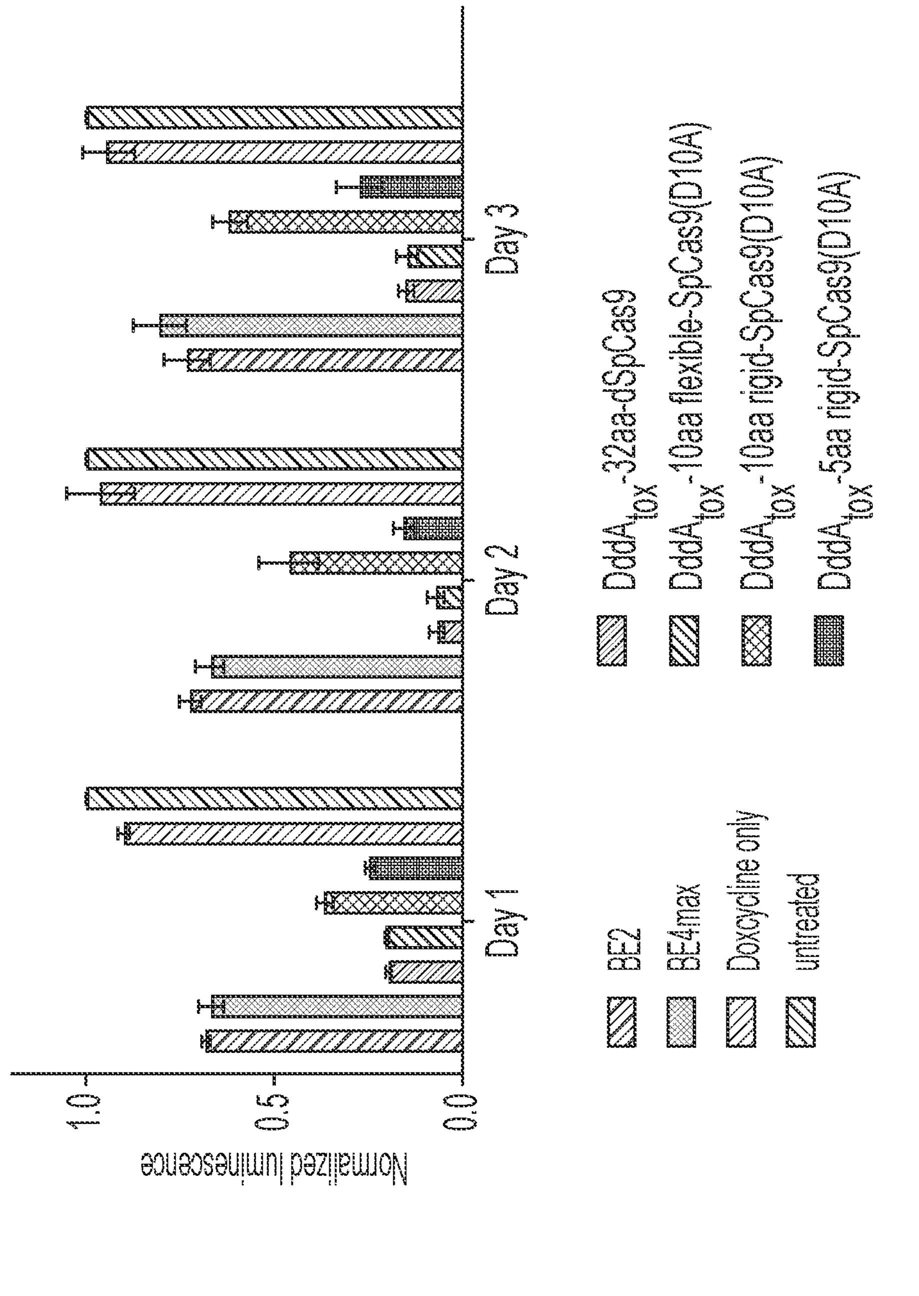
Figure 40C:
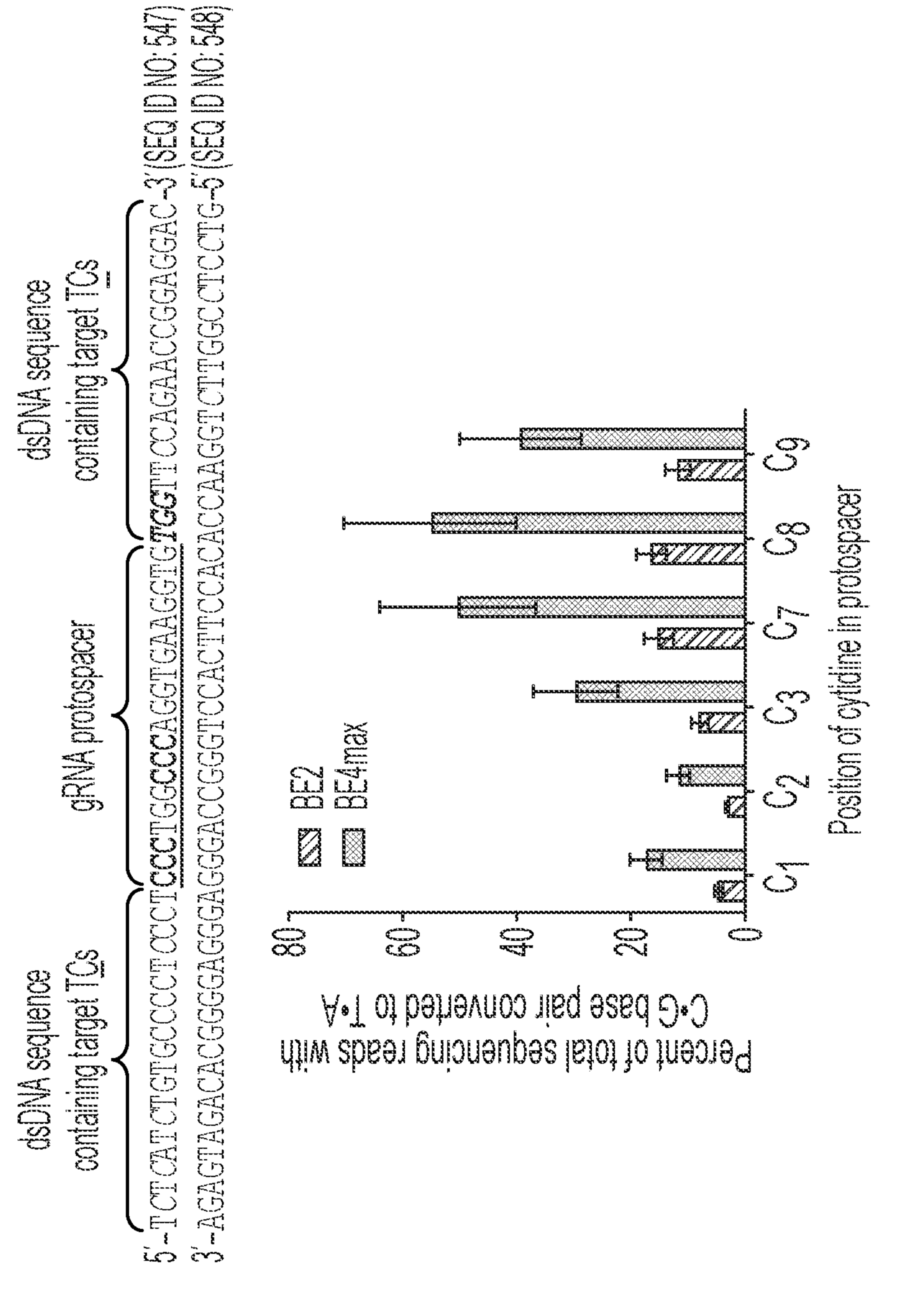

FIGS. 40A-40C show that intact $DddA_{tox}$ fused to DNA-binding protein is toxic to human cells. FIG. 40A shows architectures of BE2. BE4max and intact $DddA_{tox}$-Cas9 fusions. The $DddA_{tox}$-Cas9 linker lengths tested were 32-, 10- and 5-amino acids residues. Rigid linkers contain amino acids EAAAK (SEQ ID NO: 108) or EAAAKEAAAK (SEQ ID NO: 108). The flexible linker contains amino acids GGGGSGGGGS (SEQ ID NO: 344). Proteins expression was induced by the addition of 0.1 μg/mL doxycycline 2-4 h after plasmid transfection. FIG. 40B shows cell viability was measured by luminescence every 24 h after transfection for 3 days using the CELLTITER-GLO@2.0 assay (Promega). Luminescence values were normalized to untreated control. Values reflect the mean±s.e.m. of n=2 independent biological replicates, each performed in technical triplicates. FIG. 40C shows Cas9 binds to EMX1 protospacer (underlined) upstream of the PAM (nucleotides 41-43 of the top strand as read 5' to 3', which is also the first three nucleotides following the underlined segment as read 5' to 3' consisting of "TGG") and unwinds DNA to expose single-stranded DNA containing cytidines (nucleotides 21-23 and 27-29 of the top strand as read 5' to 3') that are substrates for C-to-T editing by BE2 and BE4max. Editing efficiencies for BE2 and BE4max 3 days post-transfection are shown below. The dsDNA regions flanking the EMX1 protospacer contain 5'-TC-3' bases (nucleotides 2, 4, 7, 17, and 46 of the top strand as read 5' to 3', and 3, 6, and 12 of the bottom strand as read 5' to 3') which can act as deamination substrates for $DddA_{tox}$-Cas9 fusions. Values and errors reflect the mean±s.d. of n=2 independent biological replicates.

Figures 41A, 41B:
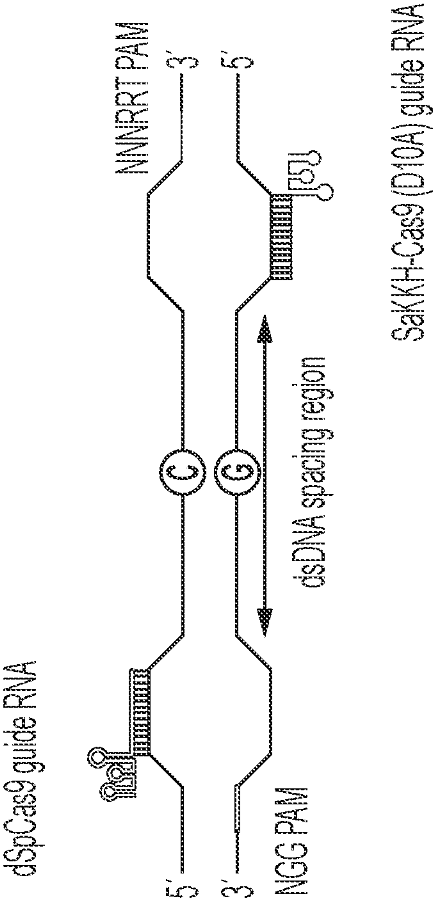

FIGS. 41A-41C show the design of guide RNAs for split-$DddA_{tox}$-Cas9 screen. FIG. 41A is a schematic of relative binding sites for dSpCas9 and SaKKH-Cas9(DI0A) gRNAs targeting the EMX1 loci. The gRNAs position the orthogonal split-DddAtox-Cas9 fusions adjacent to each other for $DddA_{tox}$ reconstitution and deamination of a target TC base within the dsDNA spacing region. FIG. 41B is a table showing the pairing of dSpCas9 guide RNAs (spG7 and spG6) with SaKKH guide RNAs (saG1 to saG4) to generate spacing regions with lengths between 12 and 60 bp. FIG. 41C shows the sequences of guide RNAs listed in (FIG. 41B). PAM sequences of dSpCas9 guide RNAs are shown as initial (most right left-side) 3 nucleotides of SEQ ID NO: 550-551 and PAM sequences of SaKKH guide RNAs are shown as the terminal (most right hand-side) 6 nucleotides of SEQ ID NO: 552-555.

Figure 42A:
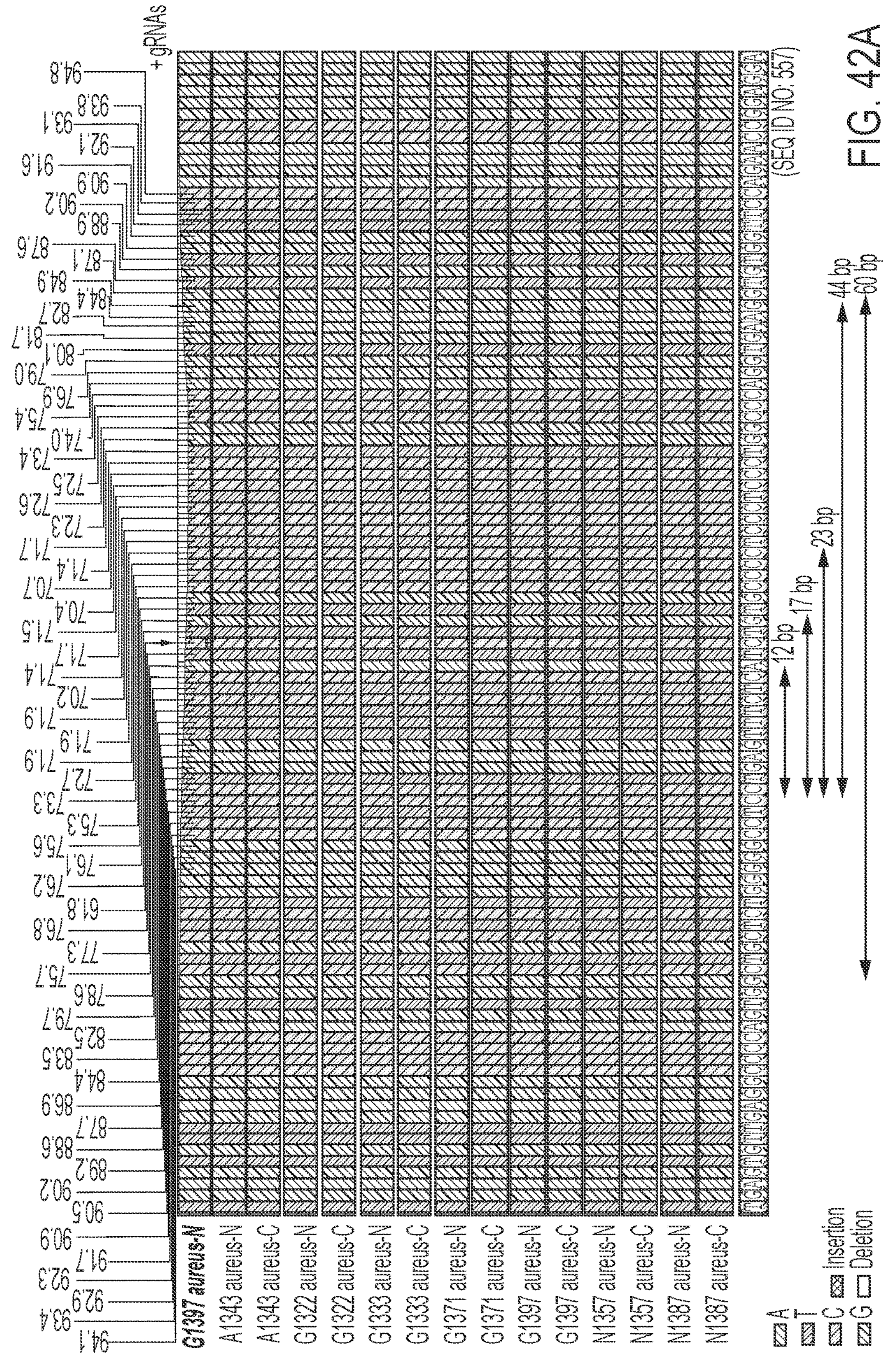
Figure 42B:
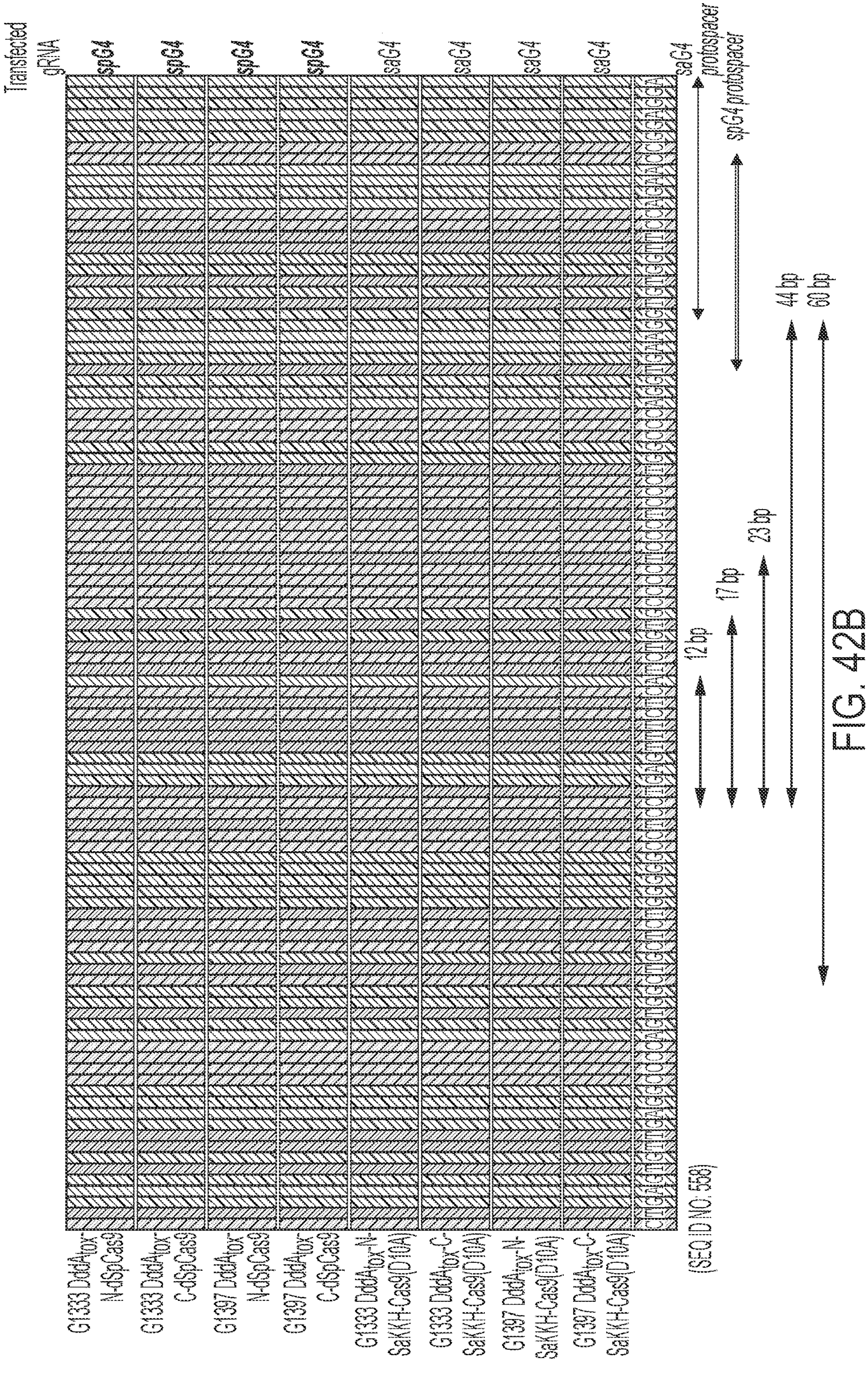

FIGS. 42A-42B show how editing strictly depends on reassembly of split-$DddA_{tox}$-Cas9 halves at target site. FIG. 42A shows base percentages at each position of the EMX1 locus are shown for all tested split orientations with no guide RNAs for dSpCas9 and SaKKH-Cas9(D10A). The nucleotide percentages for G1397 aureus-N split with gRNAs flanking a 23-bp target spacing is shown as a reference. Arrow indicates the position of C-to-T editing within the spacing region (see FIG. 24D and FIGS. 32A-32H for expected editing efficiencies of all split orientations in the presence of guide RNAs). FIG. 42B shows that, for G1333 and G1397 splits, DddAtox-dSpCas9 or DddAtox-SaKKH-Cas9(D10A) halves were directed to a site within EMX1 by a guide RNA spG4 or saG4, respectively. The reciprocal DddAtox half of each fusion was absent. Target TC bases were present 12-21 bp upstream of the protospacer. Shown are the base percentages at each position of the EMX1 locus. All nucleotide percentage plots are representative of n=2 independent replicates.

Figure 43:
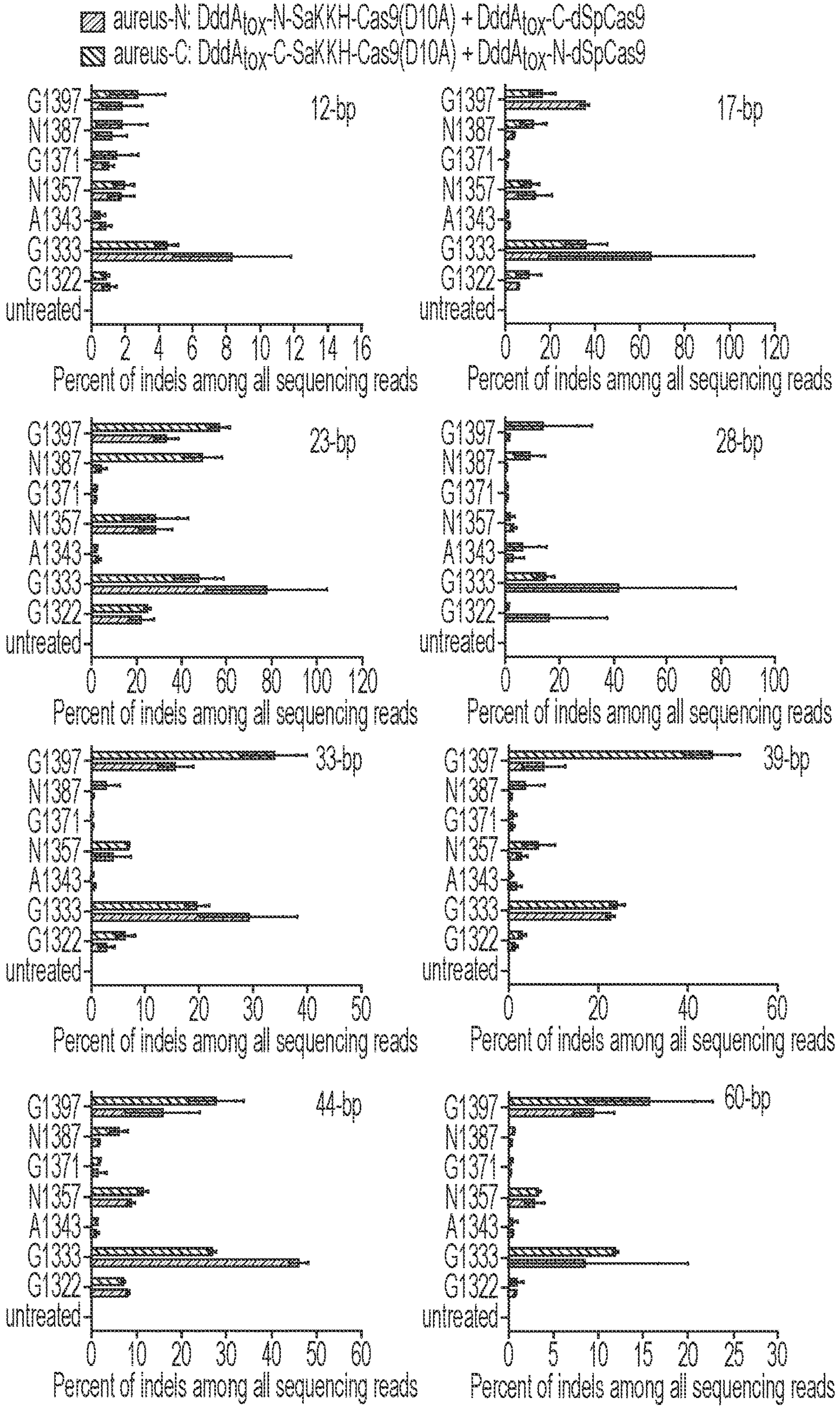

FIG. 43 shows indel frequencies of split-$DddA_{tox}$-Cas9 fusions. Percent of indels for the seven $DddA_{tox}$ splits across the indicated length of spacing region. Percent of indels among total sequencing reads for the seven $DddA_{tox}$ splits across the indicated length of spacing region. Each split was tested in the aureus-C and aureus-N orientations (see FIG. 24B for architectures). All values reflect the mean±s.d. of n=2 independent biological replicates.

Figure 44:
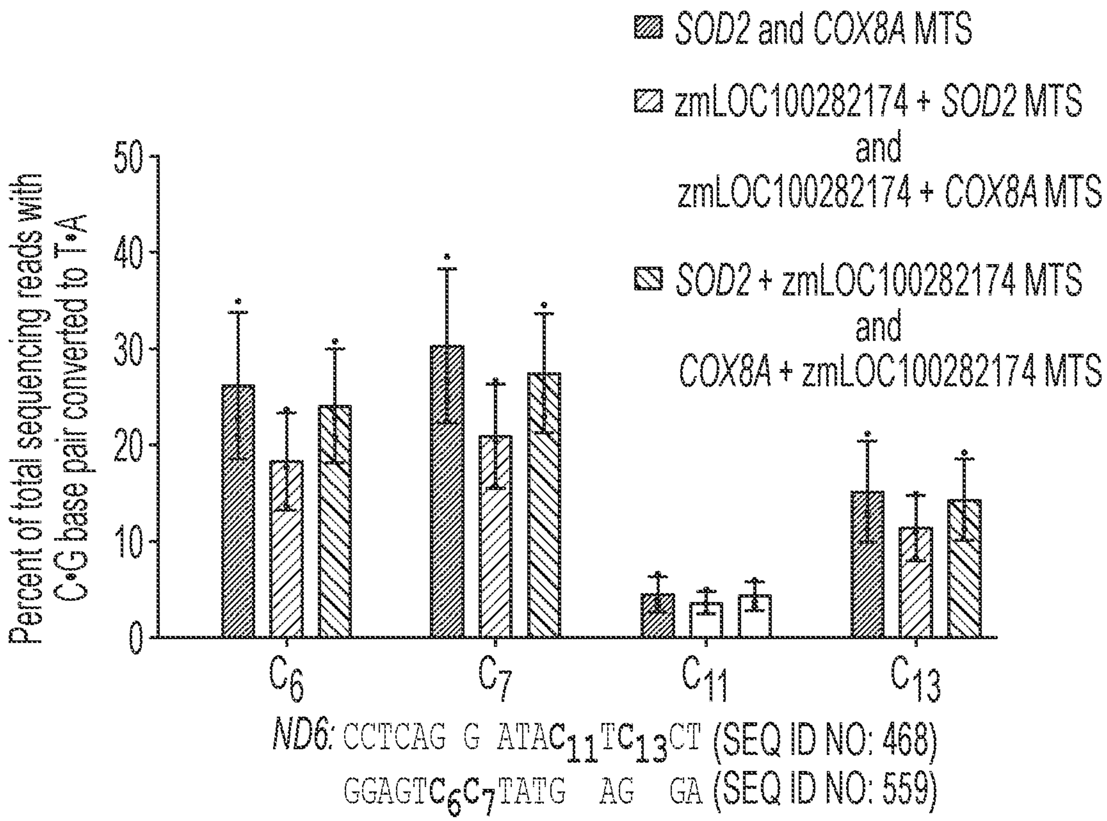

FIG. 44 shows dual MTS sequences do not improve mtDNA editing efficiencies. zmLOC100282174, a *Zea mays*-derived MTS10, was appended before or after SOD2 and COX8A MTS sequence of each MTS-mitoTALE-split DddAtox-UGI fusion. Mitochondrial editing percentages at ND6 are shown for the indicated MTS sequence combination. Values and errors reflect the mean±s.d. of n=3 independent biological replicates.

Figure 45A:
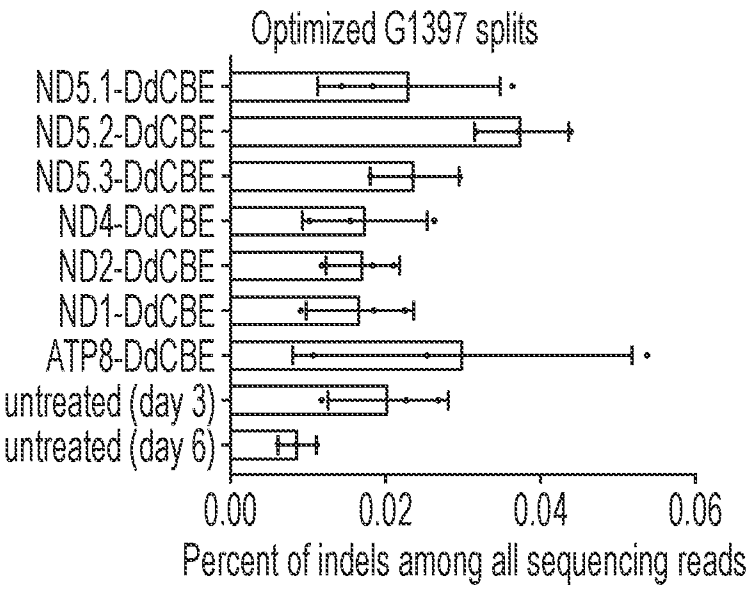
Figure 45B:
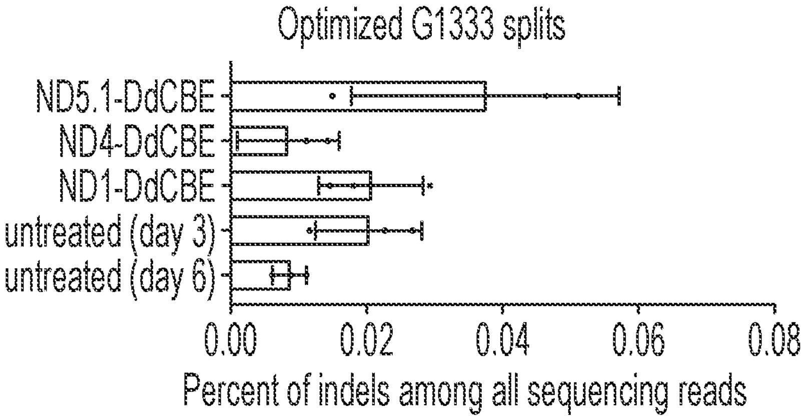

FIGS. 45A-45B show indel frequencies of DdCBEs in their optimized orientations. Shown are the percent of indels for each optimized DdCBE that produced the highest editing efficiency when DddAtox was split at G1397 (FIG. 45A) or G1333 (FIG. 45B) (see FIGS. 26A-26J for on-target editing efficiencies of optimized DdCBEs). All values and errors reflect the mean±s.d. of n=3 independent biological replicates.

Figure 46A:
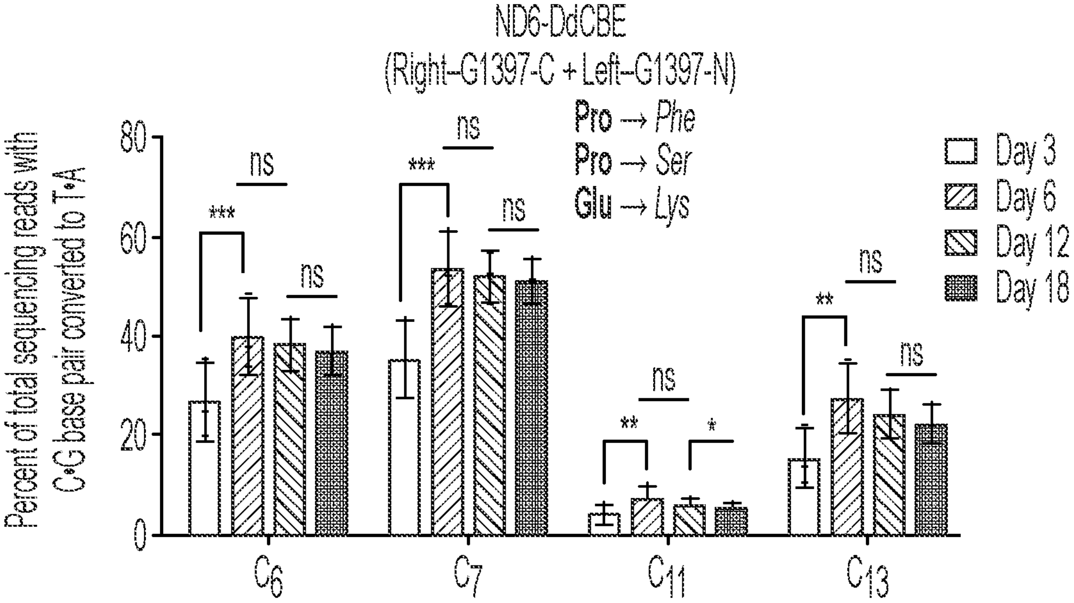
Figure 46B:
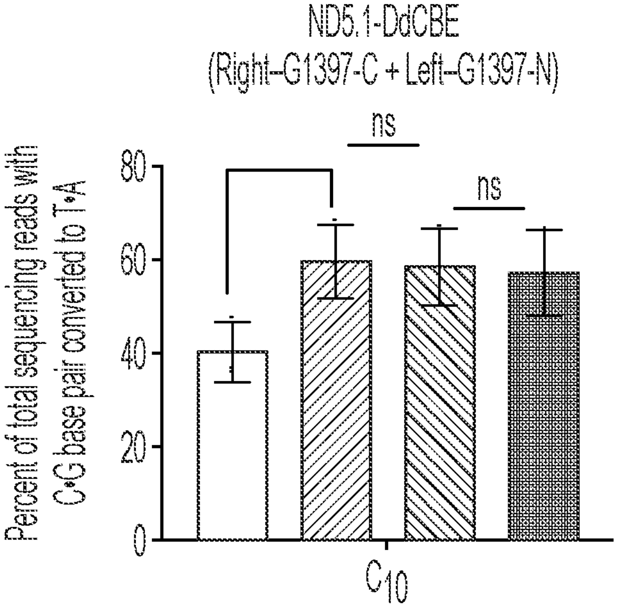
Figure 46C:
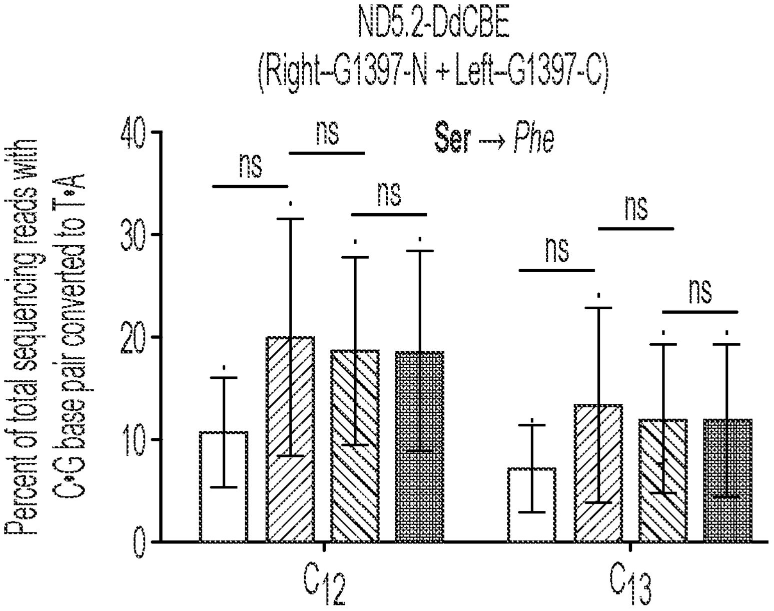
Figure 46D:
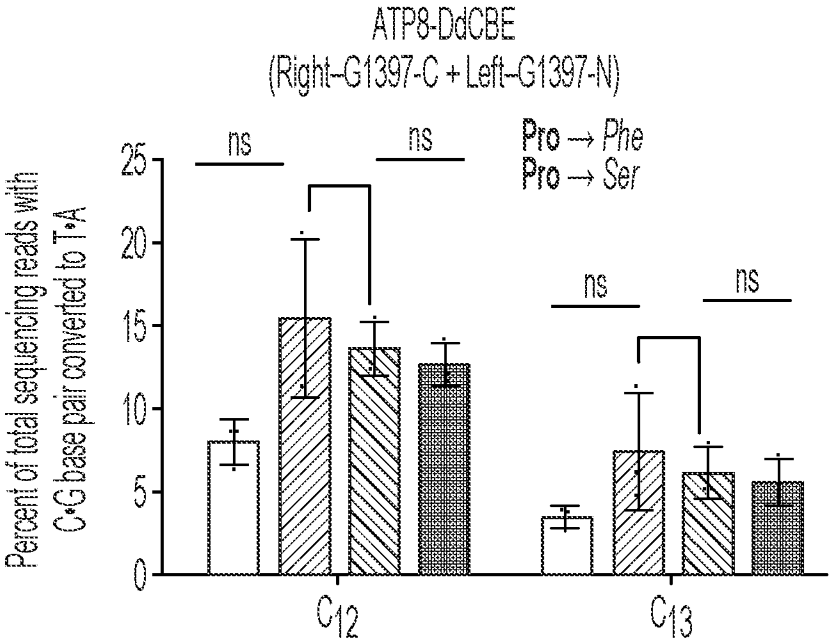
Figure 46E:
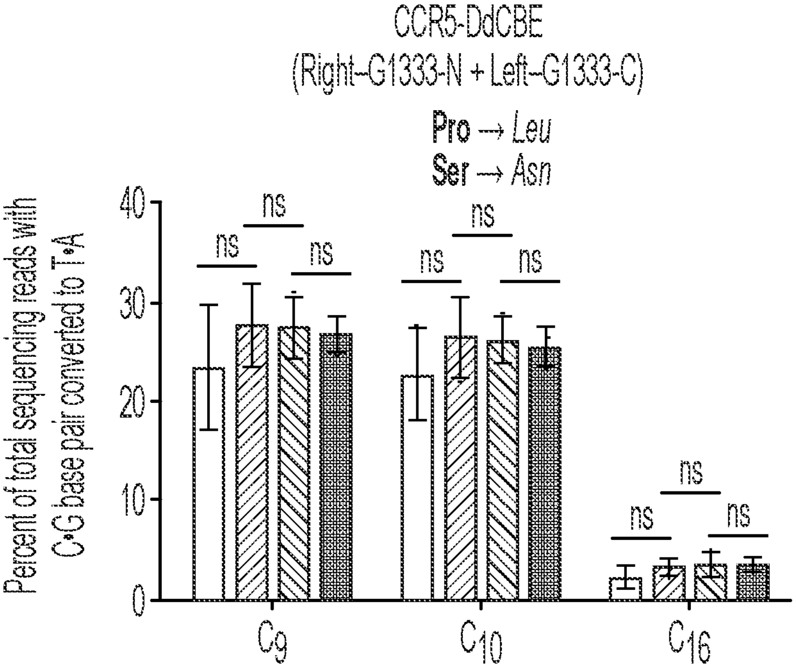

FIGS. 46A-46E show that targeted editing in the mitochondrial DNA of U20S cells persists over multiple cell divisions. Editing efficiencies for ND6-DdCBE (FIG. 46A). ND5.1-DdCBE (FIG. 46B), ND5.2-DdCBE (FIG. 46C). ATP-DdCBE (FIG. 46D) and CCR5-DdCBE (FIG. 46E) in U20S cells are shown for each timepoint. For each DdCBE, the optimized split orientation is provided in parenthesis. C•G-to-T•A conversions at protein-coding genes that generate missense mutations (green) of the putative amino acid (red) are shown. All values and errors reflect the mean±s.d. of n=3 independent biological replicates. Asterisks indicate significant editing based on a comparison between indicated time points. *P<0.05, P<0.01 and *P<0.001 by Student's two-tailed paired t-test. Individual P values are listed in Table 3.

Figure 47:
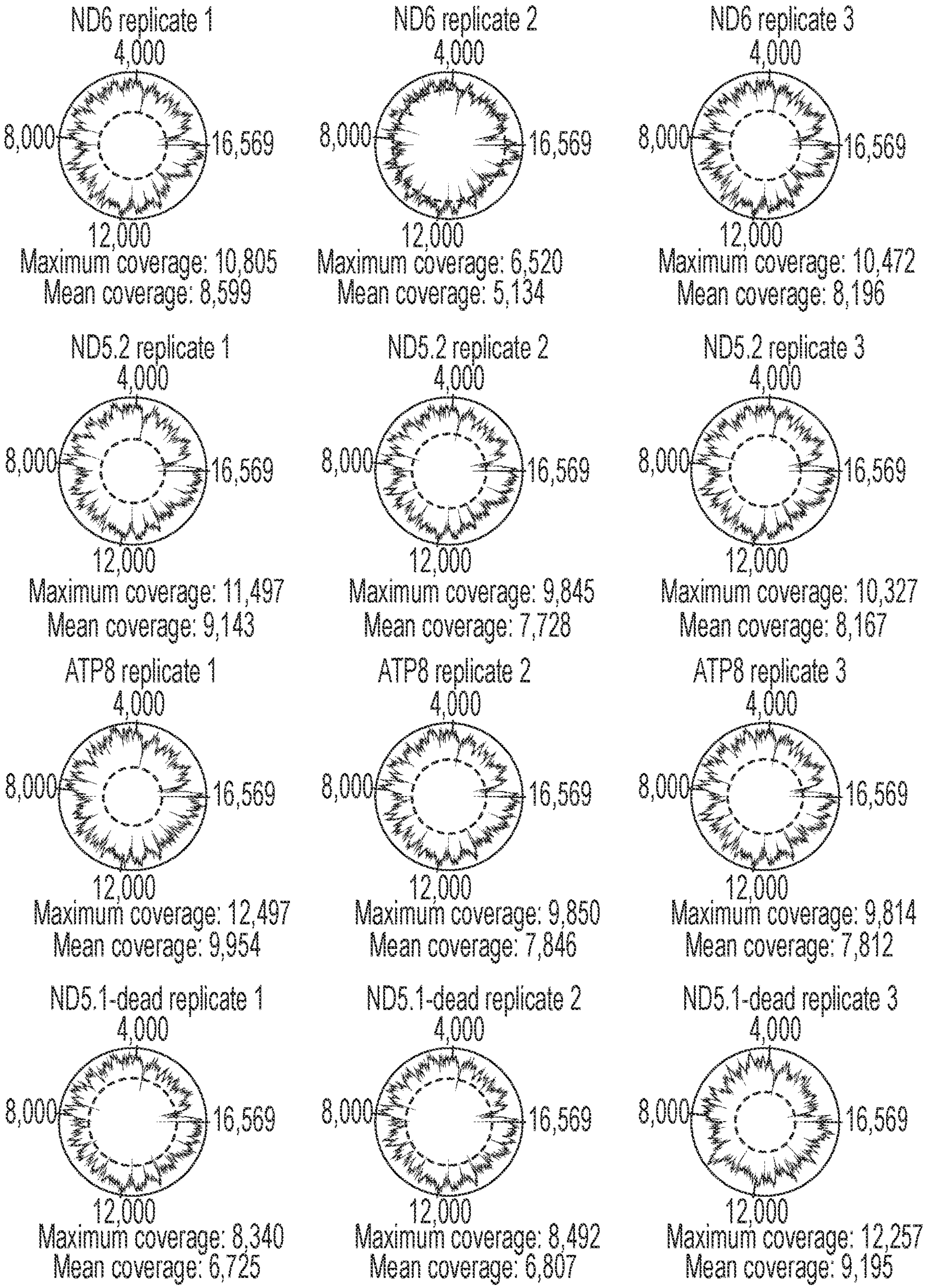
Figure 47:
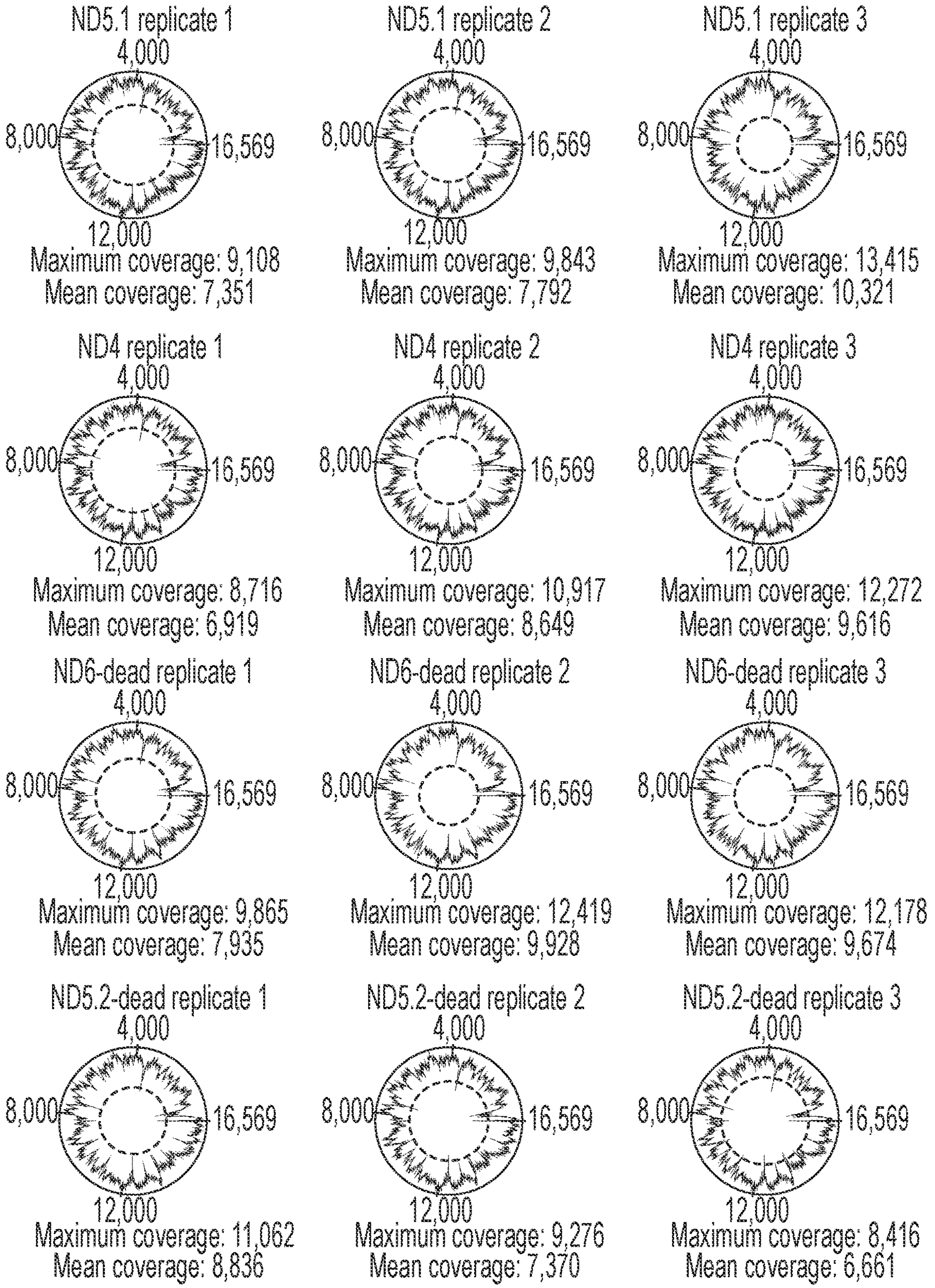
Figure 47:
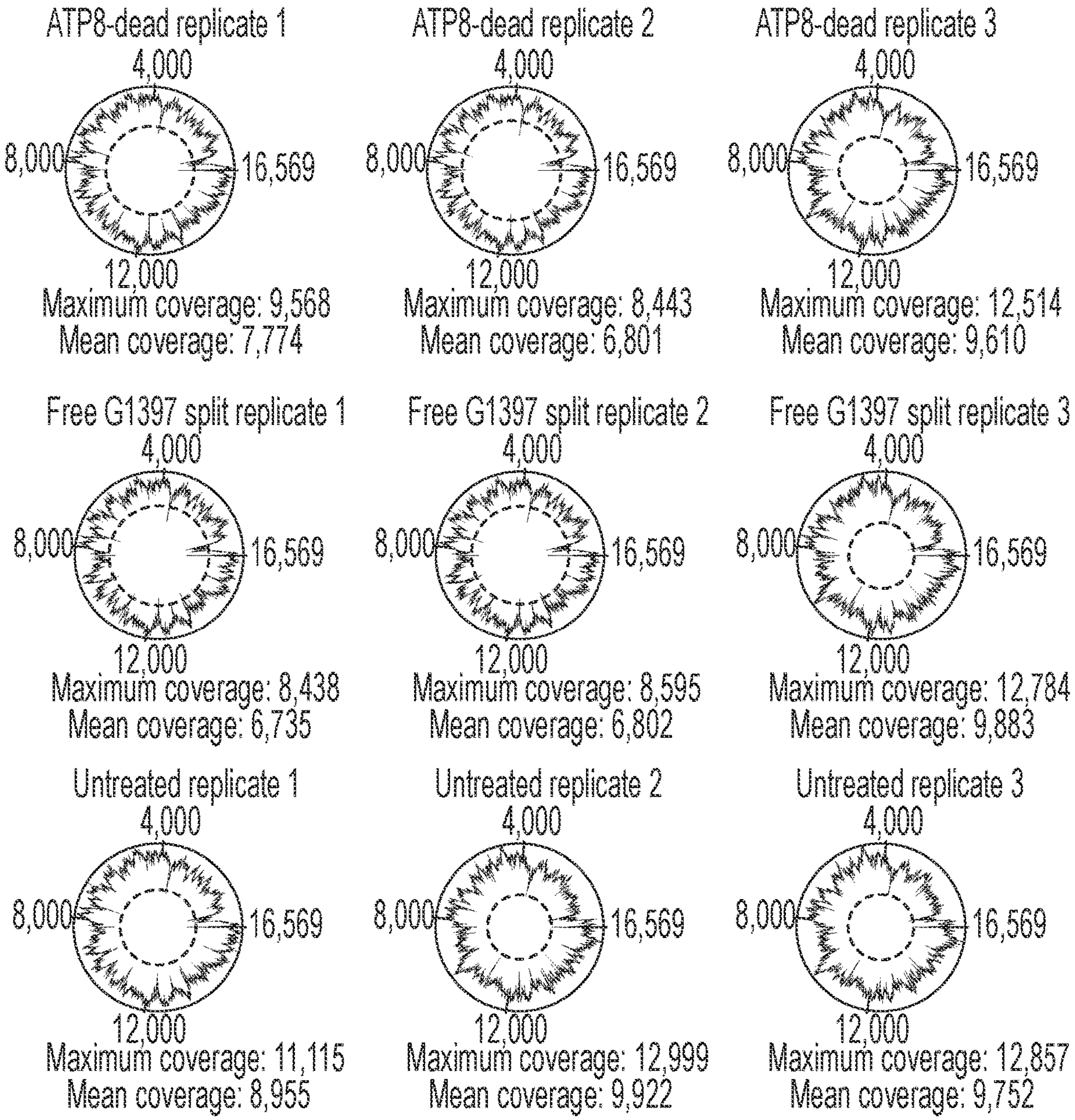

FIG. 47 shows sequencing coverage of ATAC-seq samples. Per-base sequencing coverages of each replicate treated with DdCBEs, dead-DdCBE, TALE-Free G1397 $DddA_{tox}$ and untreated control. The nucleotide positions of the human mitochondrial DNA from the NC_012920 reference genome are indicated in the exterior of each radial plot. Inner circle represent 5,000× coverage.

Figure 48A:
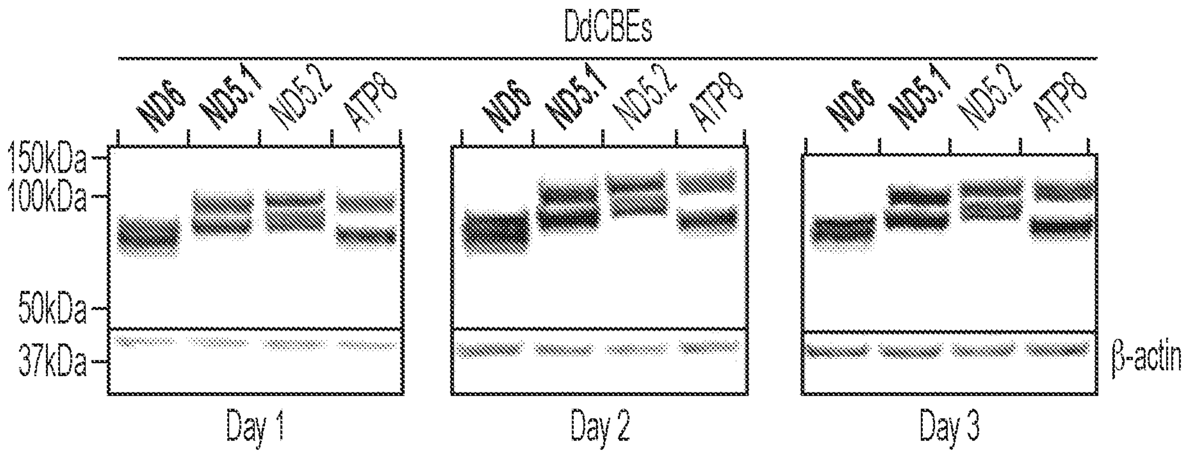
Figure 48B:
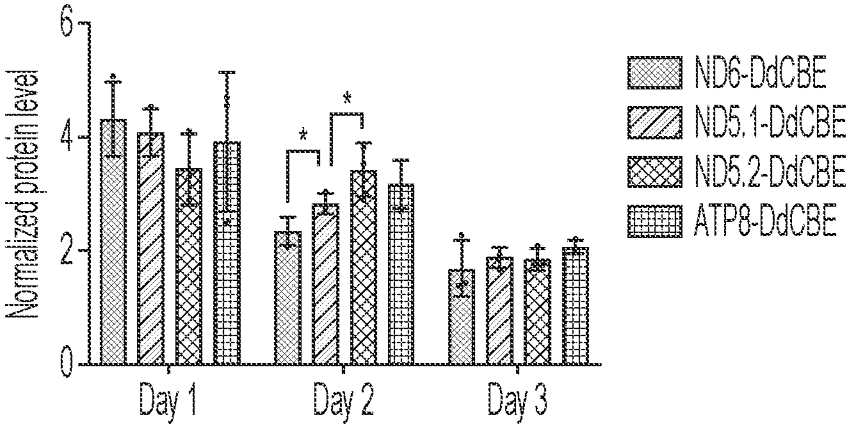

FIGS. 48A-48B show expression levels of different DdCBEs over three days. FIG. 48A shows western blots of ND6-, ND5.1-, ND5.2-, and ATP8-DdCBE at one-day intervals from crude HEK293T cell lysates over a three-day time course. The right-hand half was FLAG-tagged and the left-hand half was HA-tagged. DdCBE halves are distinguished by their molecular weight (see FIG. 53 for uncropped images and fluorescent tagging of each half). Nuclear β-actin was used as loading control. Images are representative of n=3 independent biological replicates. FIG. 48B shows proteins levels were normalized to nuclear O-actin and quantified by densitometry using ImageJ. Asterisks indicate significant editing based on a comparison between indicated time points. *P<0.05 by Student's two-tailed unpaired t-test. Values and errors reflect the mean±s.d. of n=3 independent biological replicates.

Figure 49A:
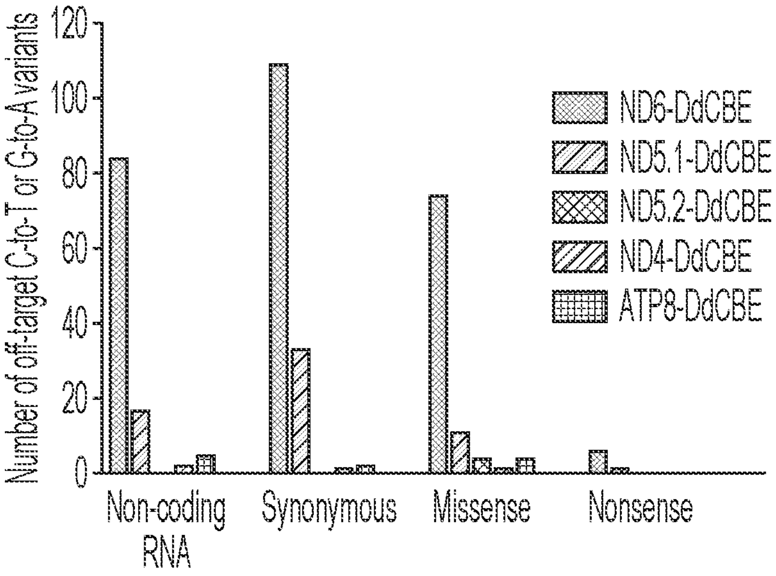
Figure 49B:
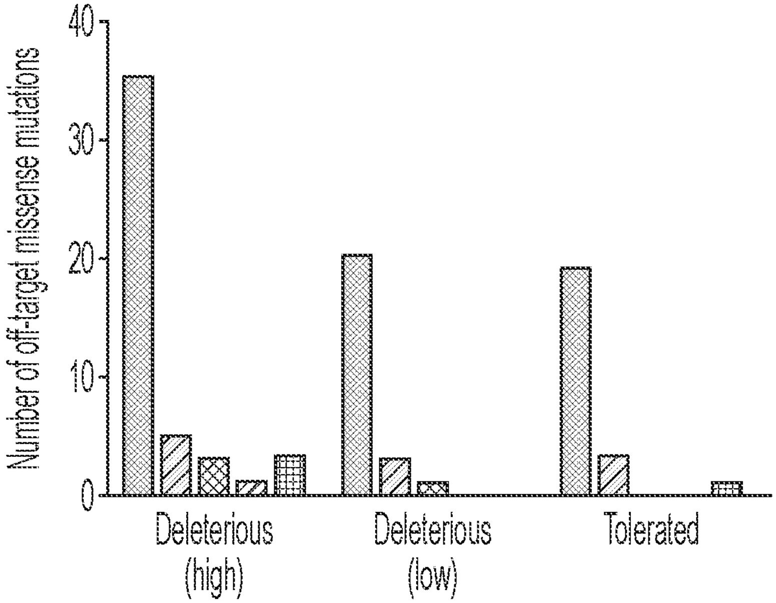
Figure 49C:
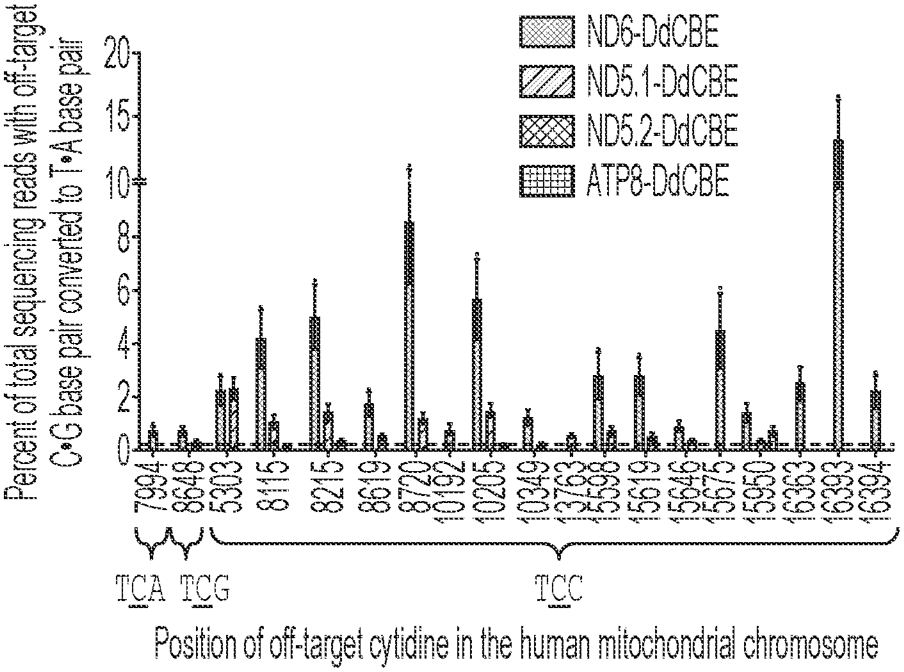

FIGS. 49A-49C show the predicted effects off-target SNVs on mitochondrial DNA sequence and protein function. FIG. 49A shows a classification off-target SNVs into noncoding or coding mutations. Mutations occurring in protein-coding regions of mtDNA were further categorized into synonymous, missense or nonsense mutations. FIG. 49B shows, for nonsynonymous SNVs, SIFT was used to predict the effect of these mutations on protein function. High- or low-confidence calls (indicated in parentheses) were made according to the standard parameters of the prediction software. FIG. 49C shows editing frequencies of selected off-target TC bases in the indicated sequence contexts following targeted amplicon sequencing. Values and errors reflect the mean±s.d. of n=3 independent biological replicates.

Figure 50:
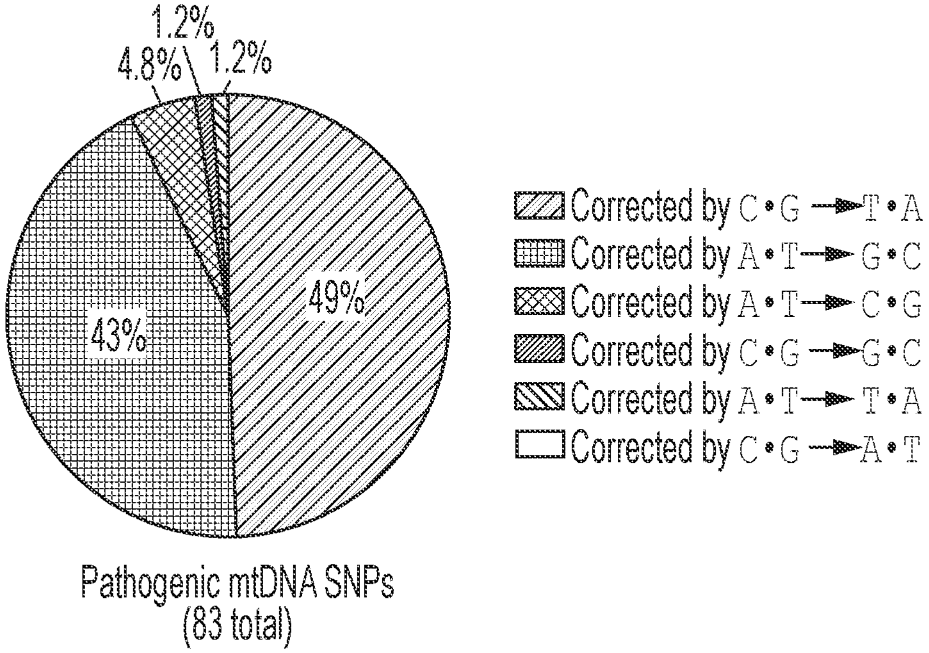

FIG. 50 shows the percentage of base pair changes needed to reverse pathogenic mtDNA point mutations in the MITOMAP database[12] (accessed Dec. 10, 2019). Disease-associated mutations in rRNA/tRNA and coding/non-coding regions were considered only if they had been assigned 'Cfrm' statuses. (see Table 6 for list of 83 pathogenic mtDNA SNPs).

Figure 51:
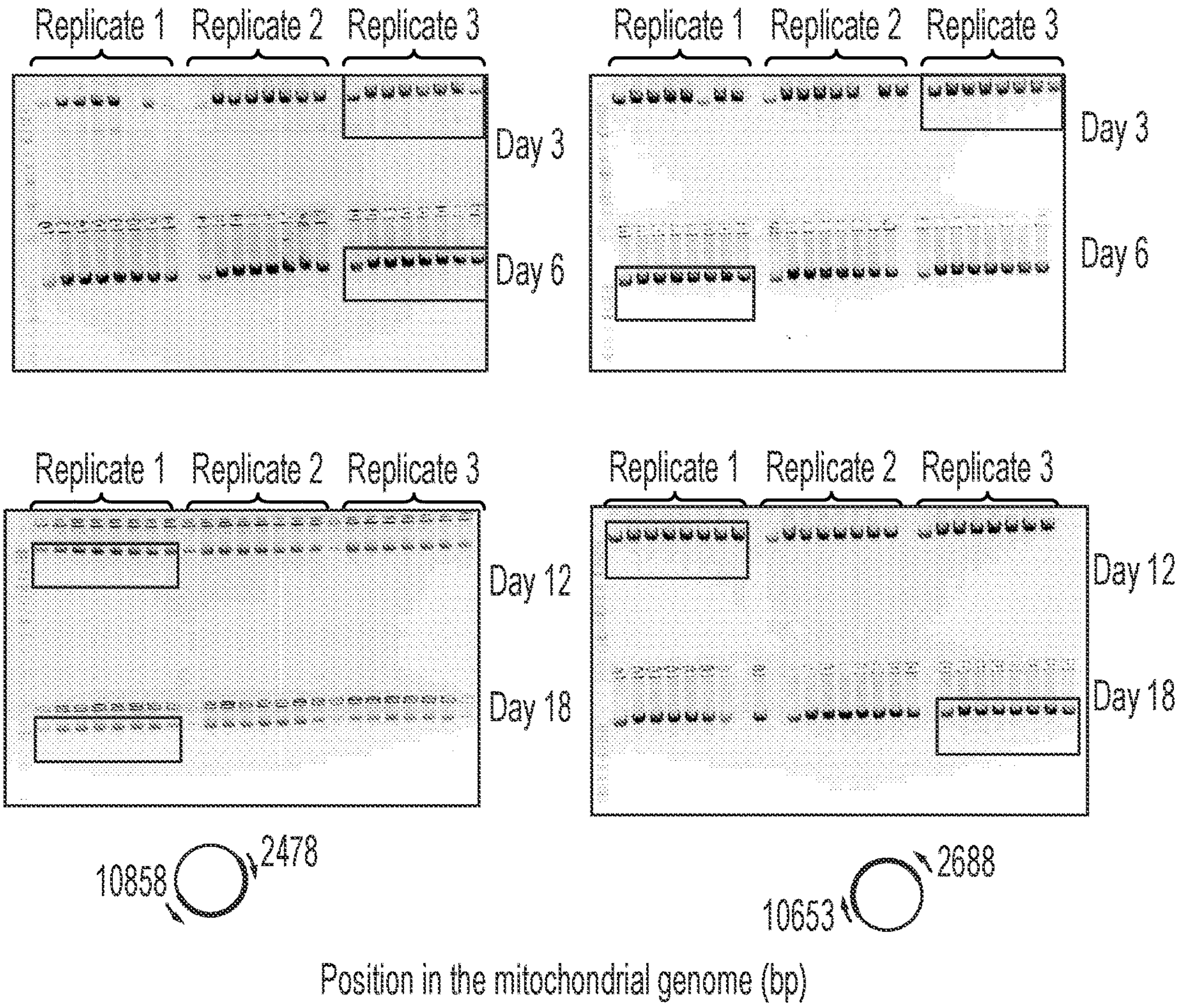

FIG. 51 shows the uncropped images for FIG. 36B.

Figure 52:
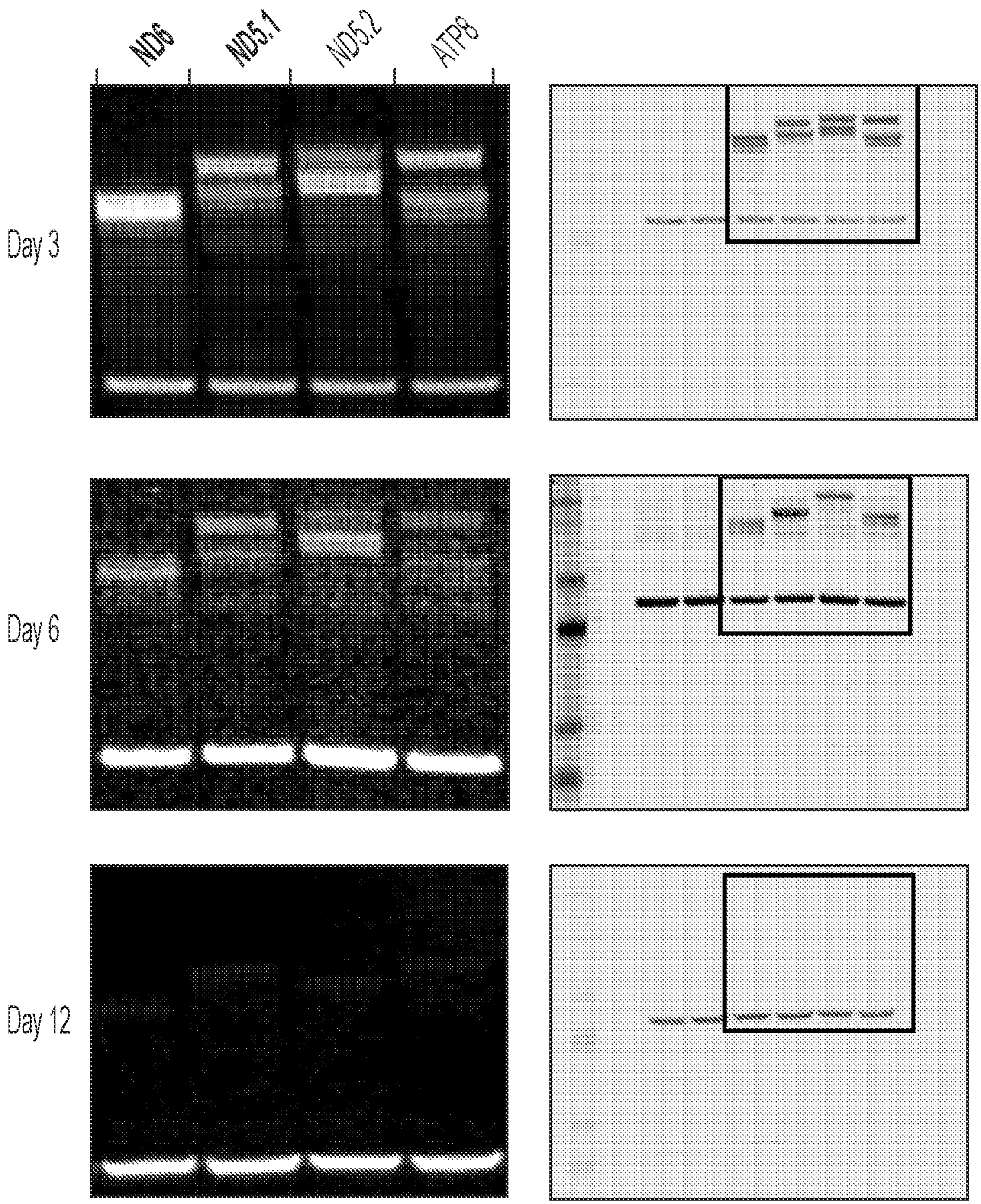

FIG. 52 shows dual fluorescence imaging of SOD2 MTS¬¬-left TALE-split DddAtox-UGI half and COX8A MTS¬¬-right TALE-split DddAtox-UGI half for each DdCBE (see FIG. 37F). The uncropped images for FIG. 37F are shown on the right.

Figure 53:
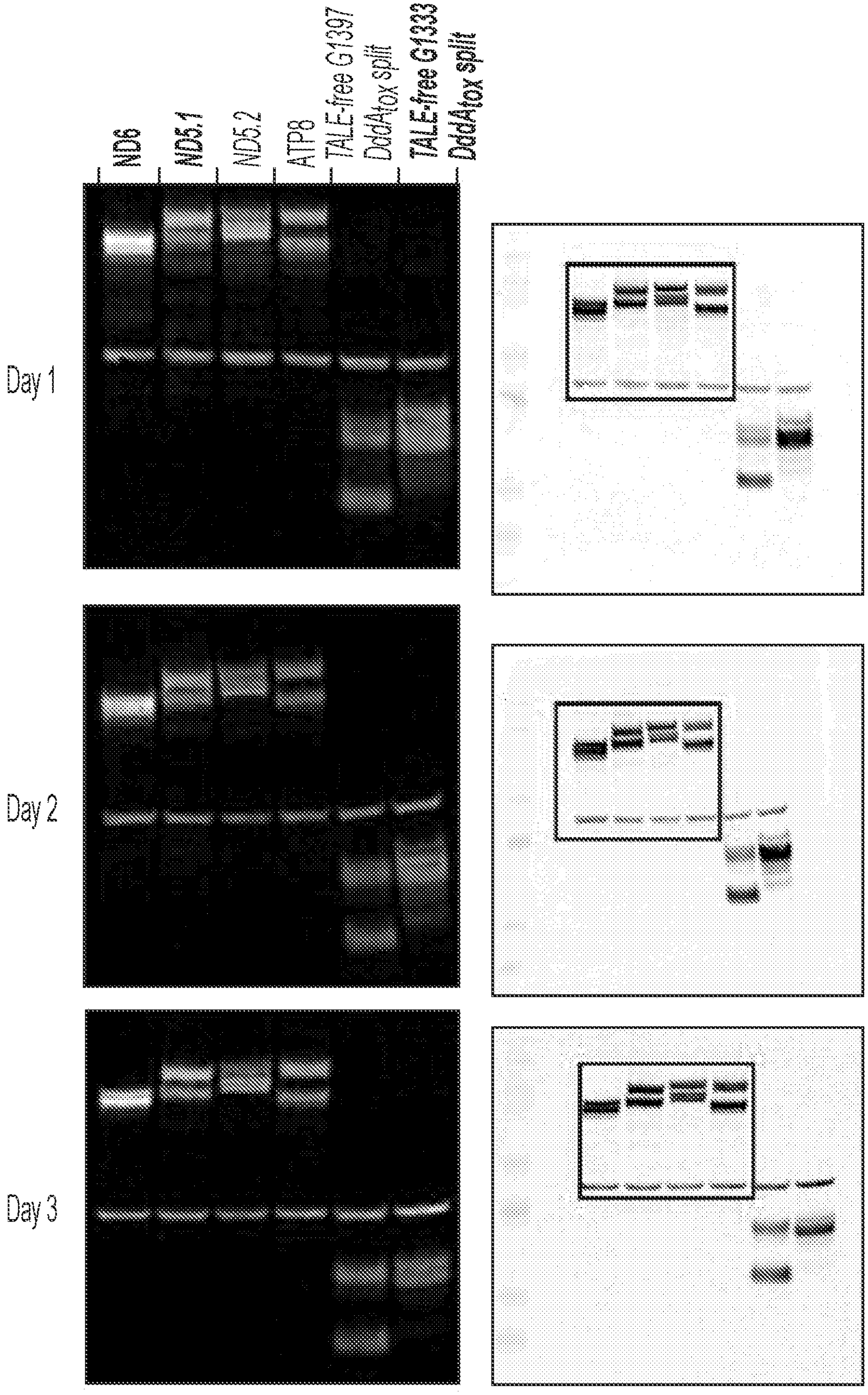

FIG. 53 shows the dual fluorescence imaging of SOD2 MTS-left TALE-split $DddA_{tox}$-UGI half and COX8A MTS-right TALE-split $DddA_{tox}$-UGI half for each DdCBE (see FIGS. 48A-48B). For expression of TALE-free split-$DddA_{tox}$, G1397-$DddA_{tox}$-N and G333-$DddA_{tox}$-N appear as bands; GI397-$DddA_{tox}$-C and G1333-$DddA_{tox}$-C appear as bands. The uncropped images for FIGS. 48A-48B are shown on the right.

Figure 54A:
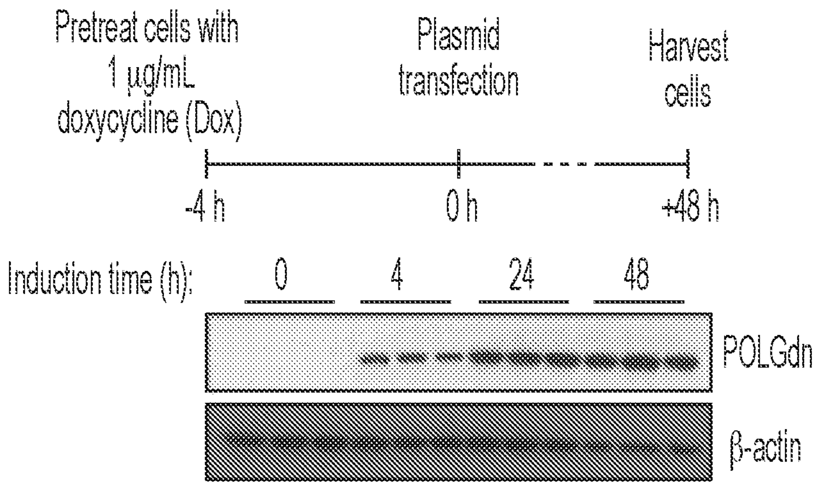
Figure 54B:
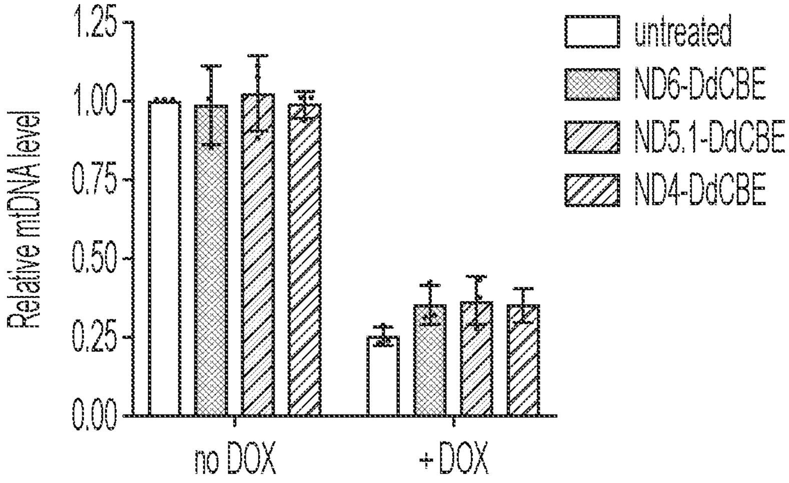
Figure 54C:
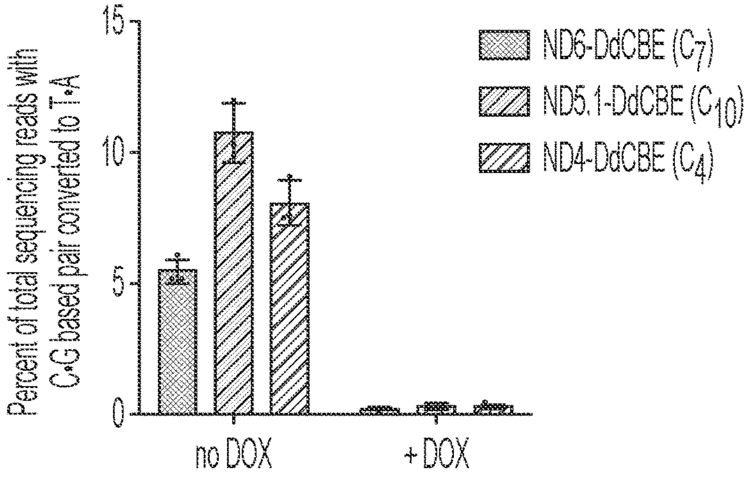

FIGS. 54A-54C show that stalling mtDNA replication impairs mitochondrial base editing in human cells. FIG. 54A is a schematic of experimental design. Addition of doxycycline (Dox) induces the stable expression of a dominant-negative mutant of DNA polymerase-gamma containing a D 1153A substitution (POLGdn) in a HEK293-derived cell line[57]. Total cell lysate was collected at indicated timepoints for western blotting of POLGdn in triplicates. FIG. 54B shows mtDNA levels of uninduced (no Dox) and induced (+Dox) cells treated with indicated DdCBE 2 days post-transfection. mtDNA levels were measured by quantitative PCR (qPCR) and normalized to uninduced cells without DdCBE treatment. FIG. 54C shows the editing efficiencies of indicated DdCBE in uninduced and induced cells 48 hours post-transfection. All values and error bars in (FIG. 54B) and (FIG. 54C) reflect the mean±s.d of n=3 independent biological replicates.

Figure 55A:
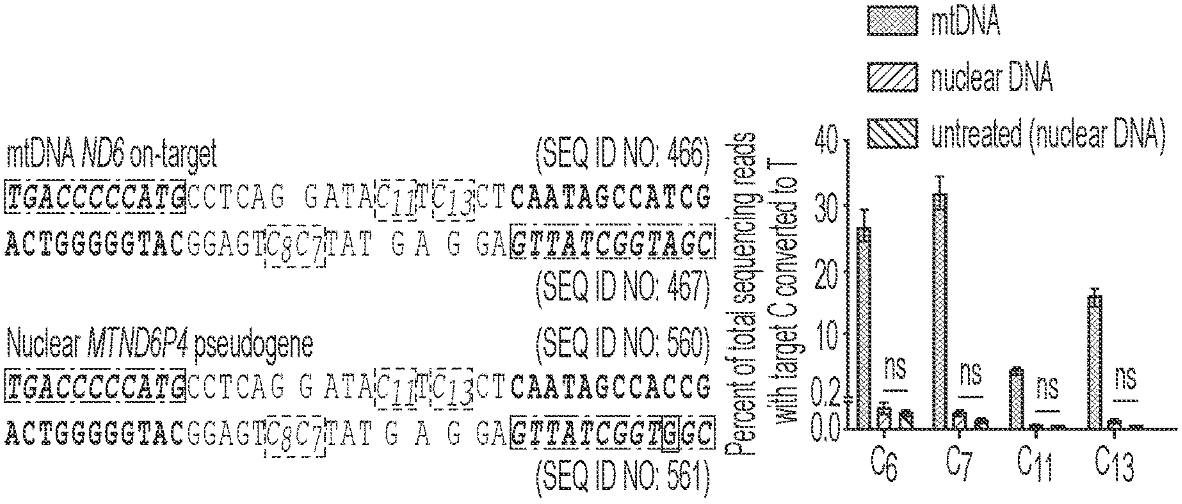
Figure 55B:
Figure 55C:
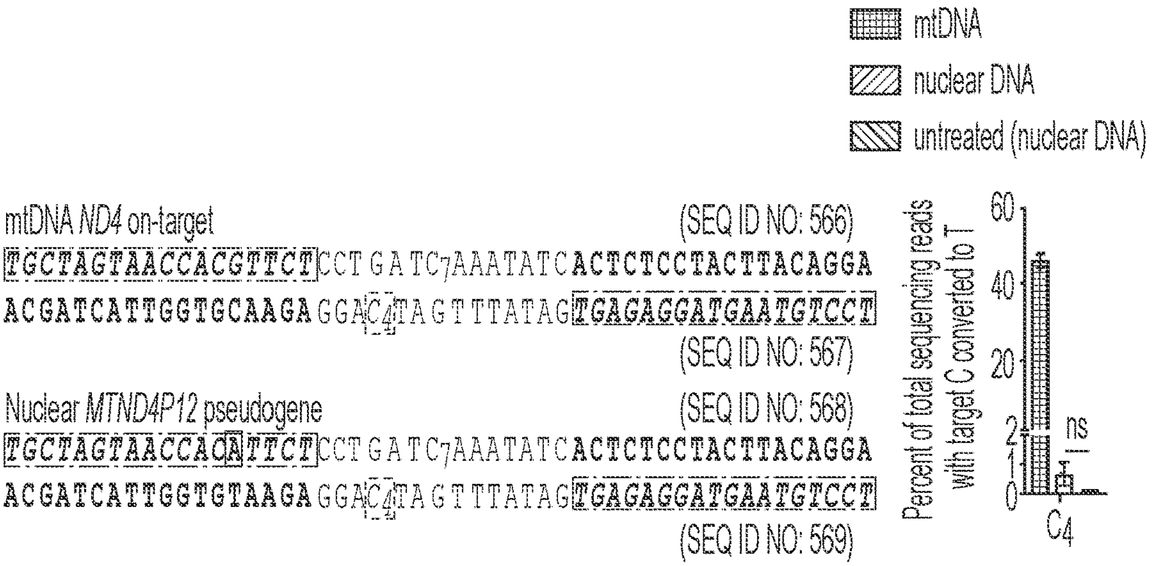

FIGS. 55A-55C show the off-target editing activity of DdCBEs in nuclear DNA of human HEK293T cells. The on-target editing site in mtDNA and the corresponding nuclear DNA sequence with the greatest homology are shown for ND6-DdCBE (FIG. 55A), ND5.1-DdCBE (FIG. 55B), and ND4-DdCBE (FIG. 55C). TALE binding sites begin at NO and are shown. Target cytidines are in C7, C8, C11, and C13. Nucleotide mismatches between the mtDNA and nuclear pseudogene are shown. Editing efficiencies are measured by targeted amplicon sequencing 3 days post-transfection (FIGS. 55A-55B) or six days post-transfection (FIG. 55C) (see Methods for primer sequences). Each amplicon was sequenced at >44,000× coverage. All values and error bars reflect the mean±s.d of n=3 independent biological replicates. Student's unpaired two-tailed t-test was applied, ns, not significant (P>0.05).

Figure 56A:
Figure 56B:
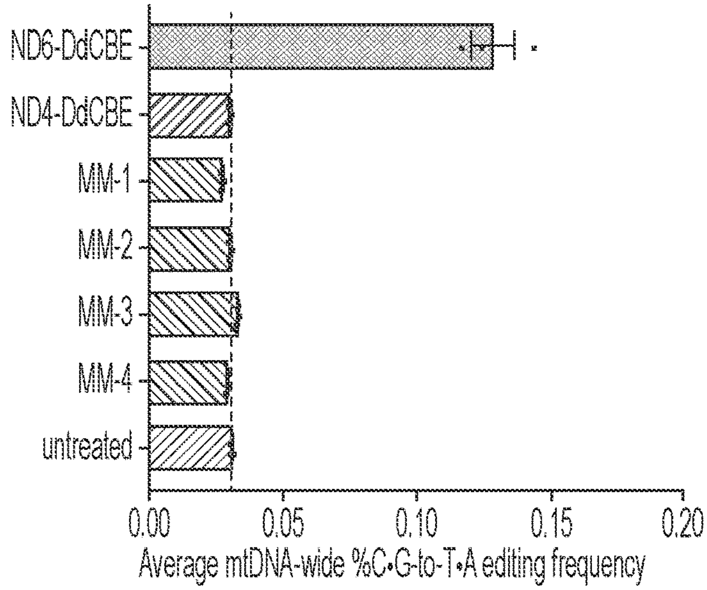

FIGS. 56A-56B show TALE arrays need to bind to mtDNA sequences positioned in close proximity to reassemble catalytically active $DddA_{tox}$ for off-target editing. FIG. 56A shows the identities and relative binding positions of each mismatched (MM) TALE-$DddA_{tox}$ half is shown. MM-1 and MM-2 contain a TALE-bound $DddA_{tox}$ half and a TALE-free $DddA_{tox}$ half. MM-3 and MM-4 contain $DddA_{tox}$ halves fused to TALE repeat arrays that bind to distant mtDNA sites. Note that m.14459-Right TALE contains a permissive N-terminal domain. FIG. 56B shows the average percentage of genome-wide C•G-to-T•A off-target editing in mtDNA by indicated DdCBE and MM pairs. The dashed line represents the percentage of endogenous C•G-to-T•A conversions in mtDNA as measured in the untreated control. Values and error bars reflect the mean±SEM of n=3 independent biological replicates.

Figure 57A:
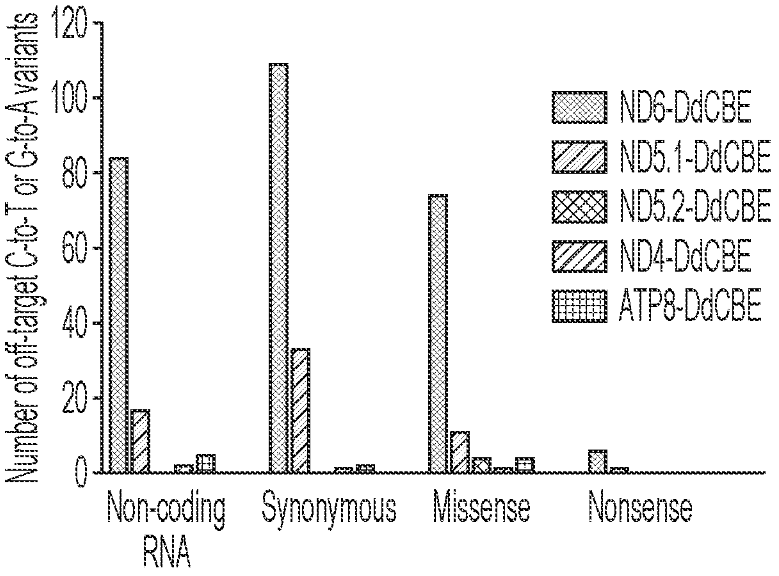
Figure 57B:
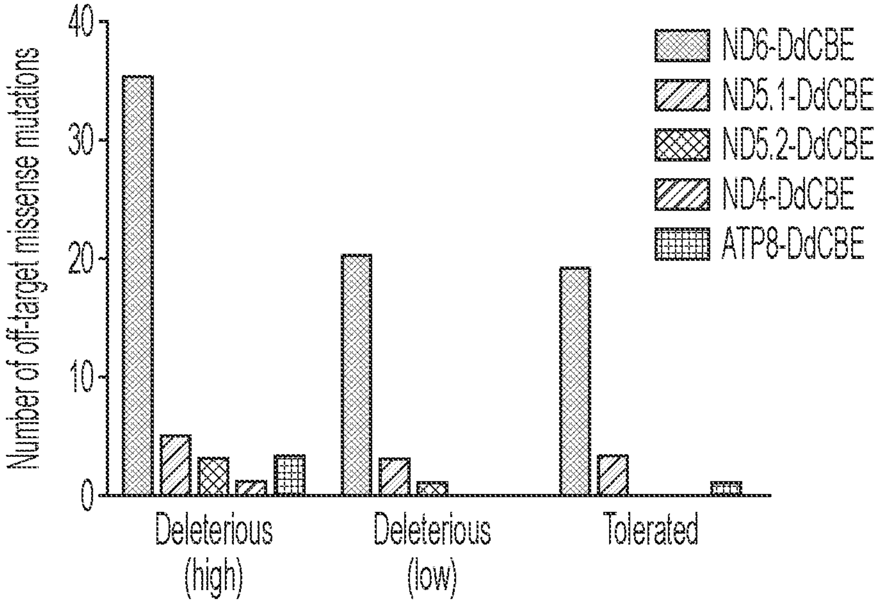
Figure 57C:
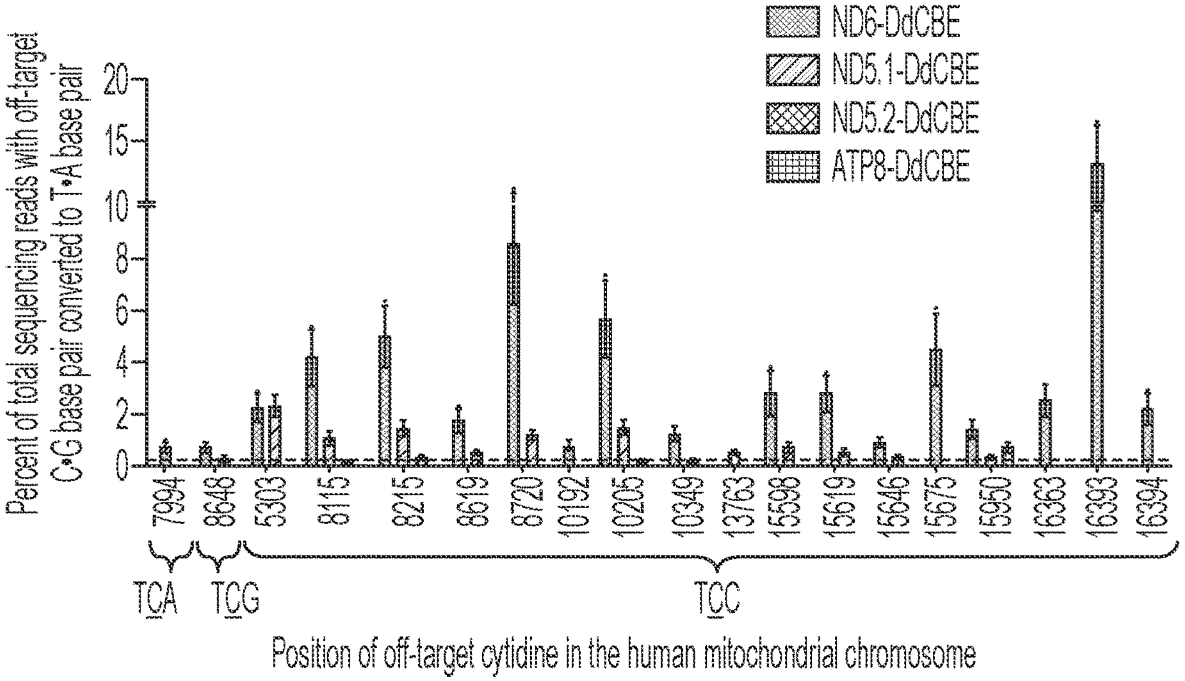

FIGS. 57A-57C show the predicted effects off-target SNVs on mitochondrial DNA sequence and protein function. FIG. 57A shows the classification off-target SNVs into noncoding or coding mutations. Mutations occurring in protein-coding regions of mtDNA were further categorized into synonymous, missense or nonsense mutations. FIG. 57B shows that for nonsynonymous SNVs, SIFT was used to predict the effect of these mutations on protein function. High- or low-confidence calls were made according to the standard parameters of the prediction software. FIG. 57C shows the editing efficiencies of selected off-target TC bases in the indicated sequence contexts. HEK293T cells were treated with indicated DdCBE and harvested 3 days post-transfection for targeted amplicon sequencing. Values and error bars reflect the mean±s.d. of n=3 independent biological replicates.

Figure 58:
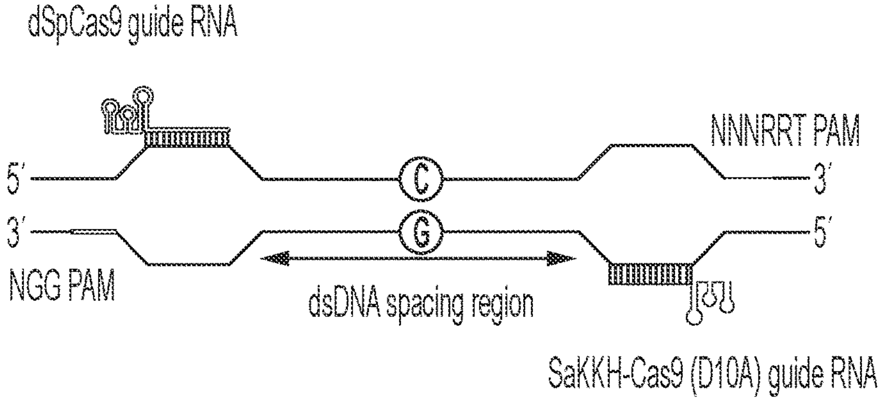

FIG. 58 is a schematic of relative binding sites for dSpCas9 and SaKKH-Cas9(D10A) gRNAs targeting the EMX1 loci. The gRNAs position the orthogonal split-$DddA_{tox}$-Cas9 fusions adjacent to each other for $DddA_{tox}$ reconstitution and deamination of a target TC base within the dsDNA spacing region.

Figure 59:
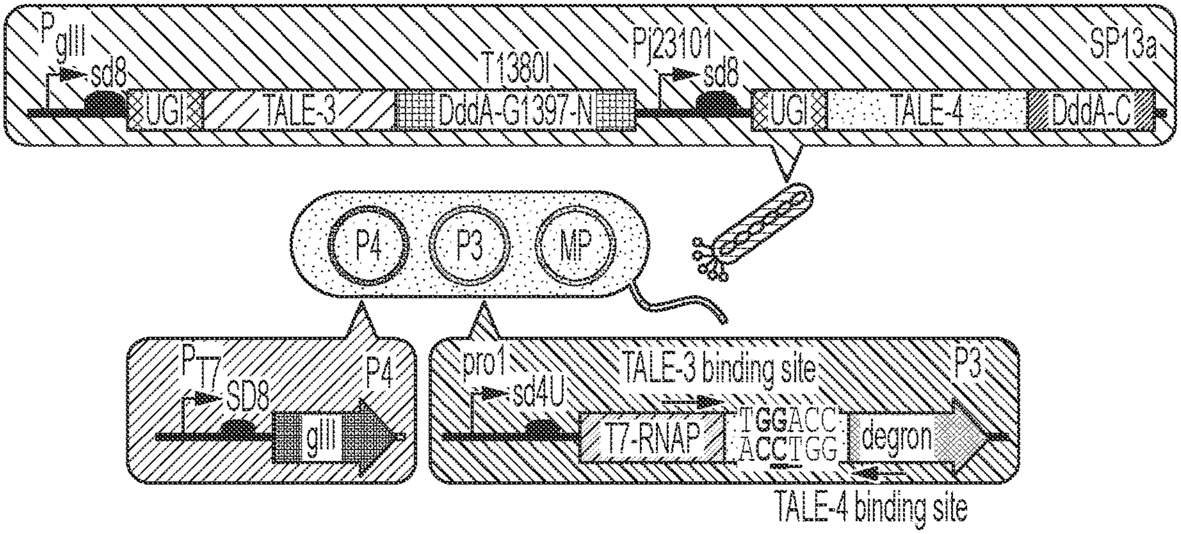

FIG. 59 is a schematic showing the selection circuit in PANCE or PACE for evolving split DddA towards higher activity at TC context. DdCBE is encoded in M13 bacteriophage. Plasmid P3 is in the *E. coli* host cell and encodes for T7 RNA polymerase (T7 RNAP) fused to a degron. TALE-3 and TALE-4 target DNA sequences flanking a linker region within the T7 RNAP-degron fusion. Successful base editing at the linker sequence introduces a stop to remove the degron from T7 RNAP during translation. T7 RNAP is restored and binds to the T7 promoter on Plasmid P4 to drive gIII. Since gIII is required for phage infectivity, phages containing active DdCBEs will propagate and overtime.

Figure 60A:
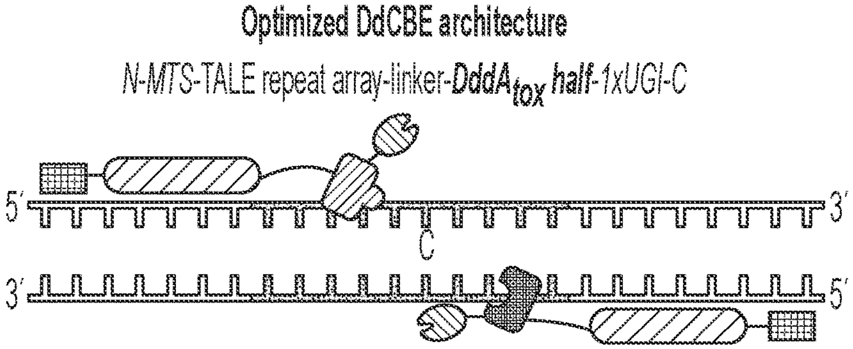
Figure 60B:
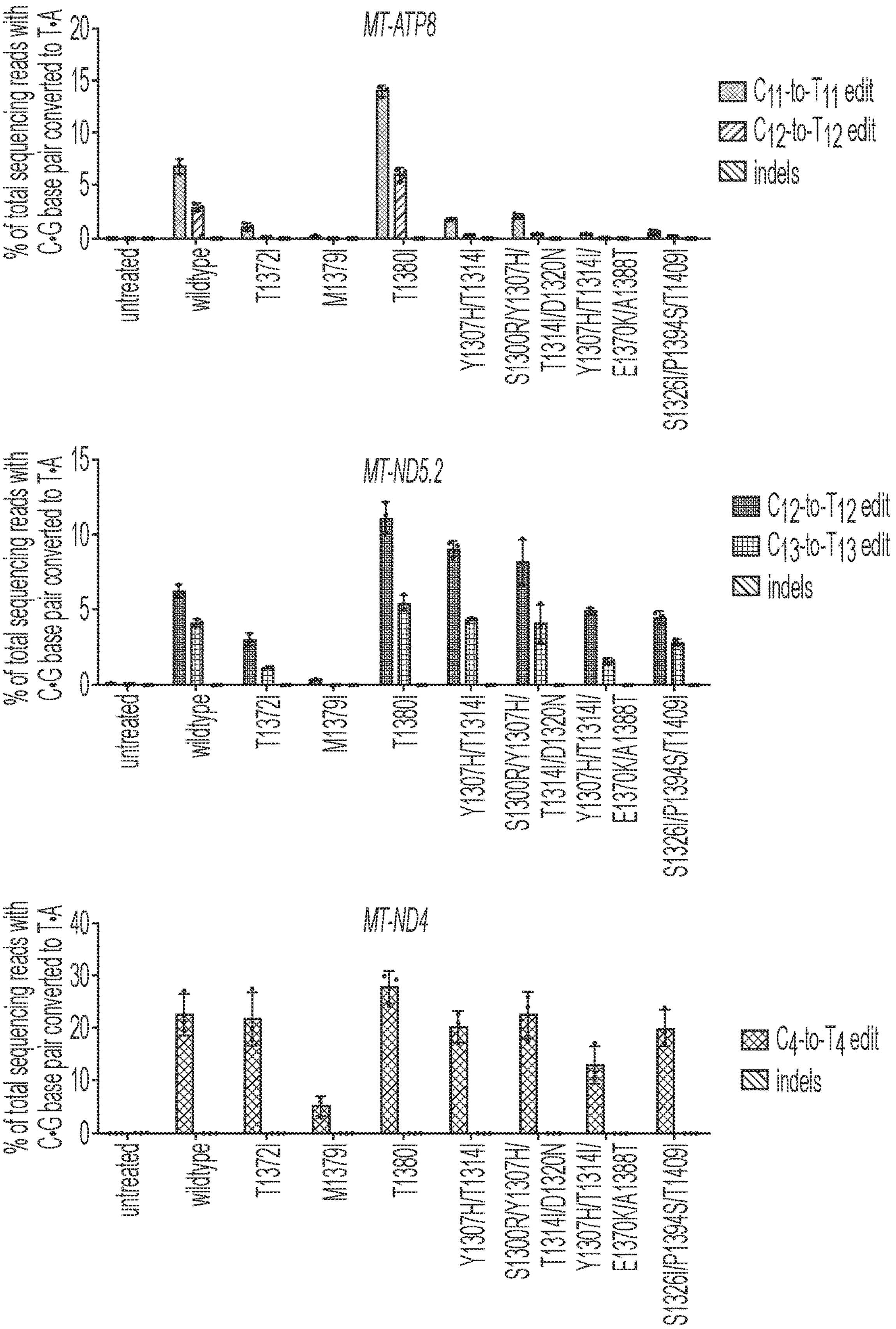
Figure 60C:
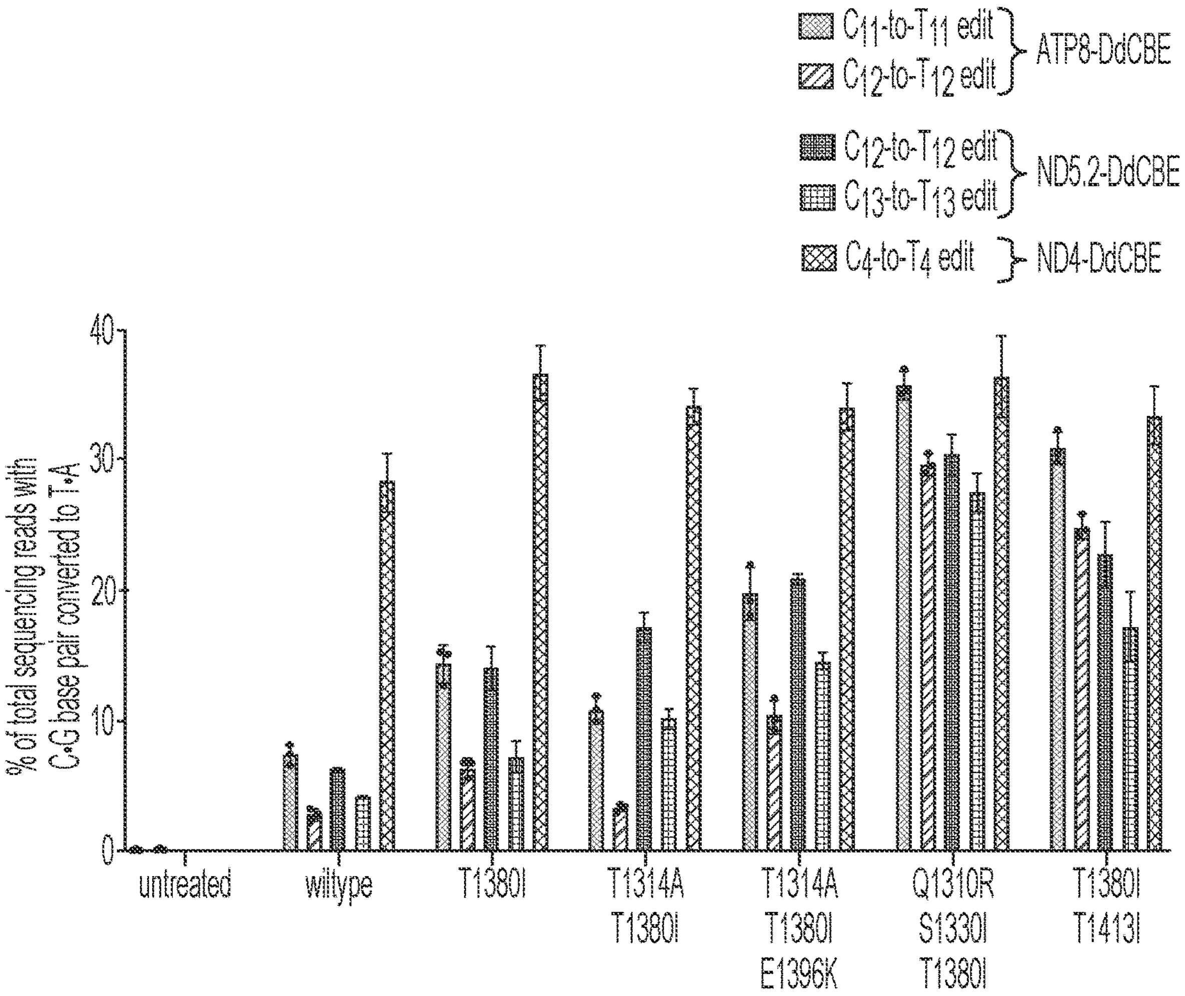
Figure 60D:
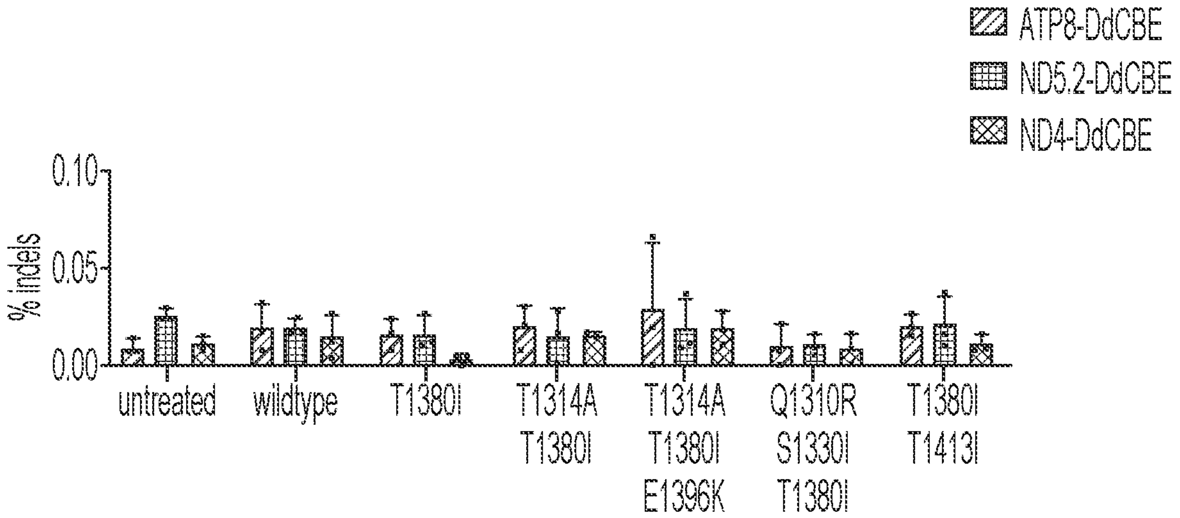

FIGS. 60A-60D show editing activity of DdCBE mutants in mammalian HEK293T cells. FIG. 60A shows DdCBE protein architecture used to test mutant activity. FIGS. 60B-60C show editing efficiencies of DdCBEs targeting MT-ATP8, MT-ND5.2 and MT-ND4 3-days post transfection. FIG. 60D shows indel percentages associated with DdCBE editing.

Figure 61:
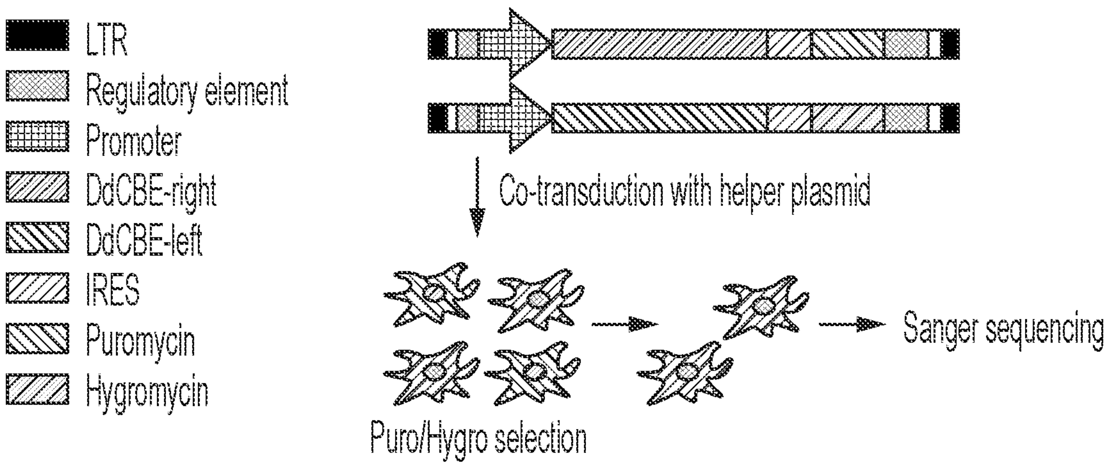

FIG. 61 is a schematic showing DdCBE is packaged into two lentiviral vectors for transduction into mouse embryonic fibroblasts.

Figure 62:
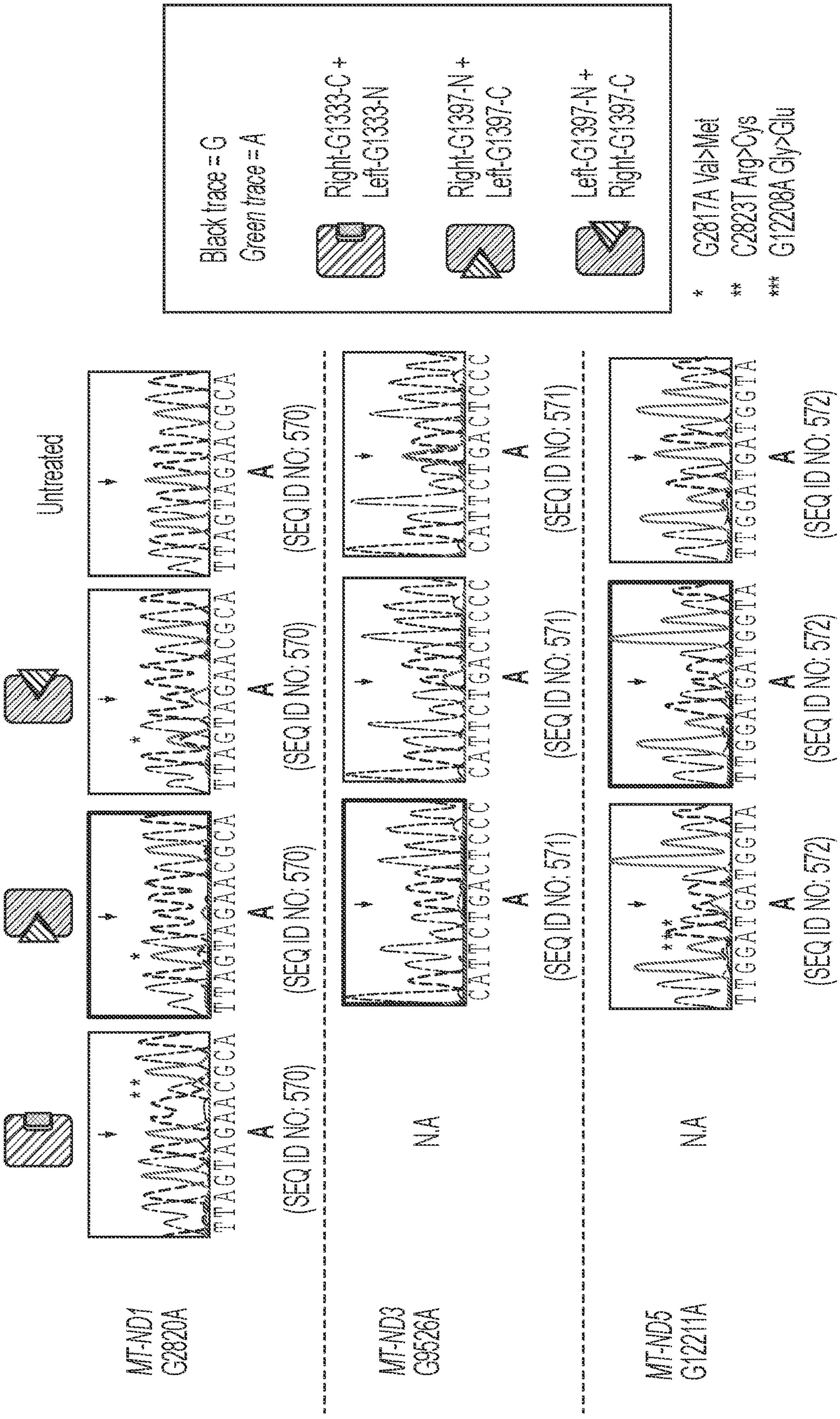

FIG. 62 shows Sanger sequencing of mtDNA from mouse embryonic fibroblasts treated with indicated DdCBEs. Arrow indicates the target GC base pair. The appearance of a light trace at the target G position indicates C•G-to-T•A conversion. Off-target bystander mutations are indicated in asterisks. Outlined in bold indicate the DdCBE orientation that resulted in the highest C•G-to-T•A conversion.

Figure 63:
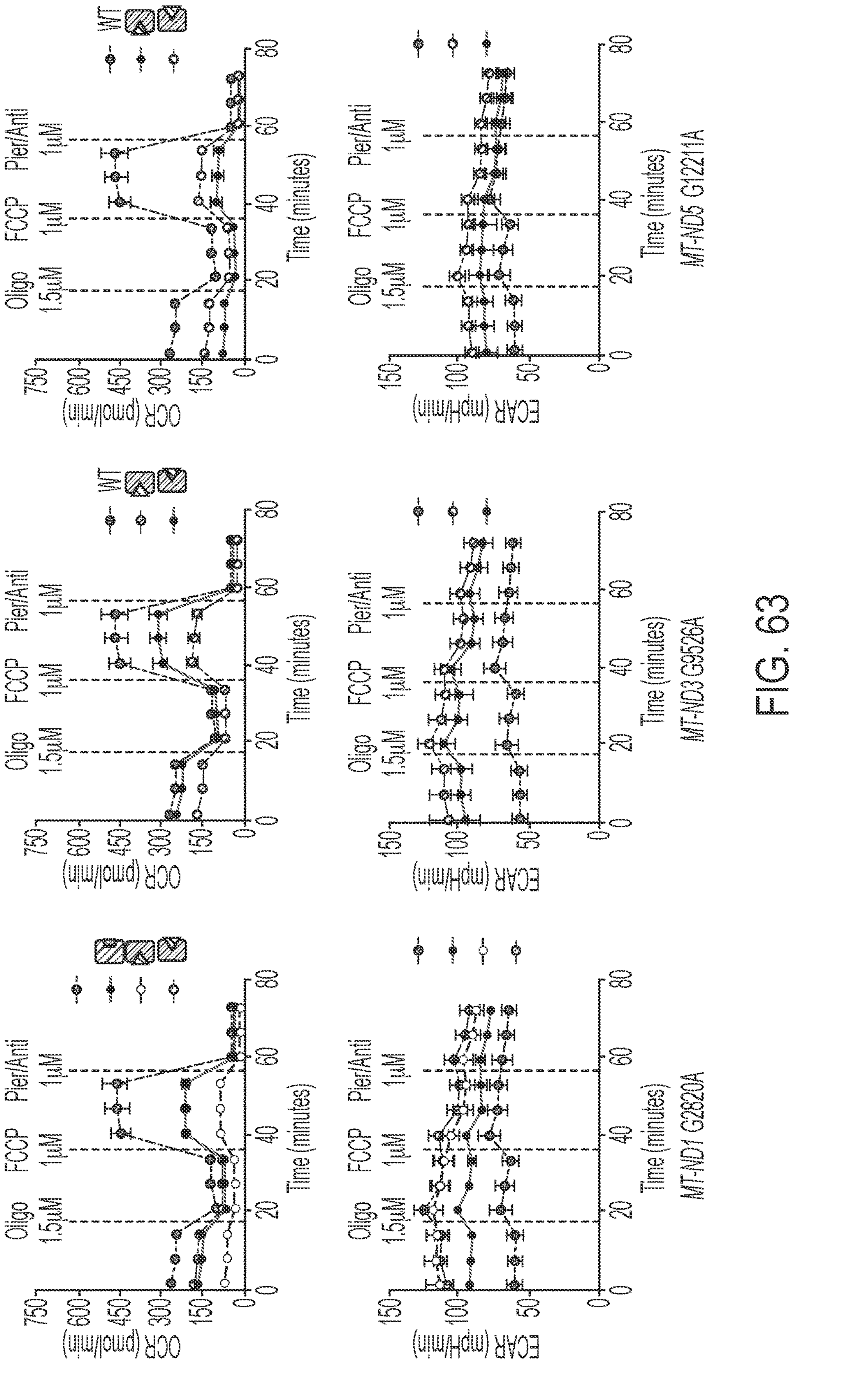

FIG. 63 shows results of mitochondria function characterization of edited MEF cells. For each mutation installed, the oxygen consumption rate (OCR) measurements and extracellular acidification rate (ECAR) are shown in the top and bottom panels, respectively.

Figure 64A:
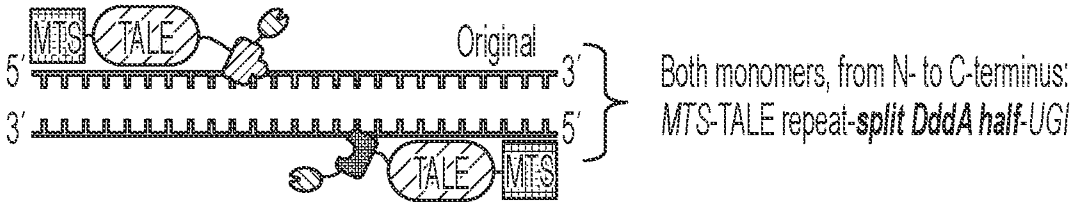
Figure 64B:
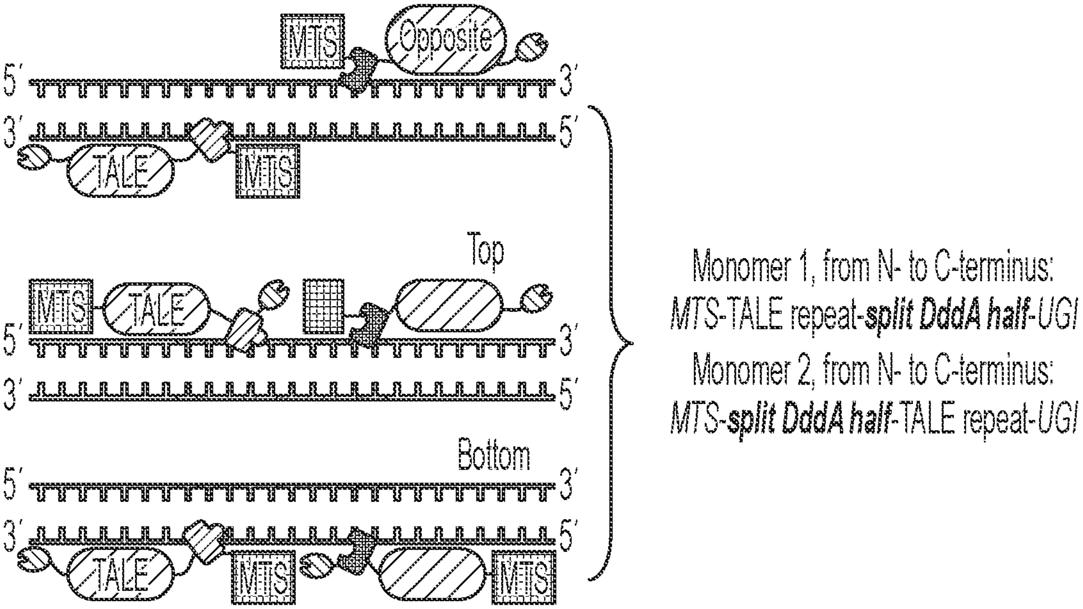

FIGS. 64A-64B are schematics comparing the different DdCBE architectures for target mtDNA binding. FIG. 64A shows that Left-TALE binds to top strand and Right-TALE binds to bottom strand. Each UGI protein is in close proximity to the target spacing region. FIG. 64B shows schematics of "opposite". "top" and "bottom" architecture. "Opposite" shows Left-TALE binds to bottom strand and Right-TALE binds to top strand. Both UGI proteins are distal to the target spacing region. "Top" shows both TALE proteins bind to the top strand. "Bottom" shows both TALE proteins bind to the bottom strand. In top and bottom architecture, only one UGI protein is close to the target site.

Figure 65:
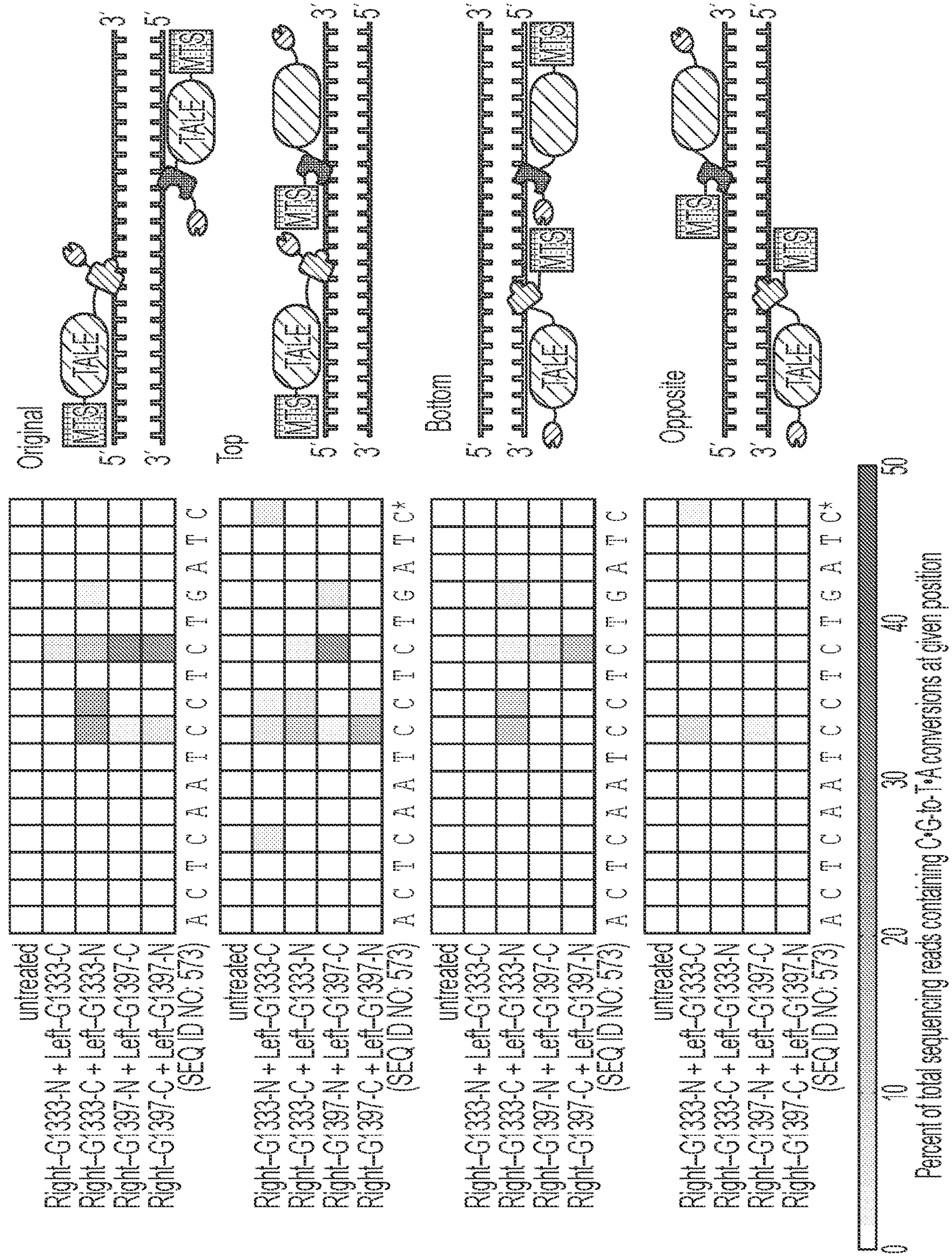

FIG. 65 shows editing activity of alternative DdCBE architectures in mammalian HEK293T cells. Heatmaps showing C•G-to-T•A conversion at MT-ND1 for Original, Top, Bottom and Opposite architectures. Each architecture was tested in its four possible DddA split orientations. "*" indicates that the cytidine C is within the TALE binding site.

FIG. 66 shows binding motifs used in ZF-BE design (Gersbach et al. Acc. Chem. Res. 2014. 7(8); 23309-2318).

Figure 67:
Figure 68A:
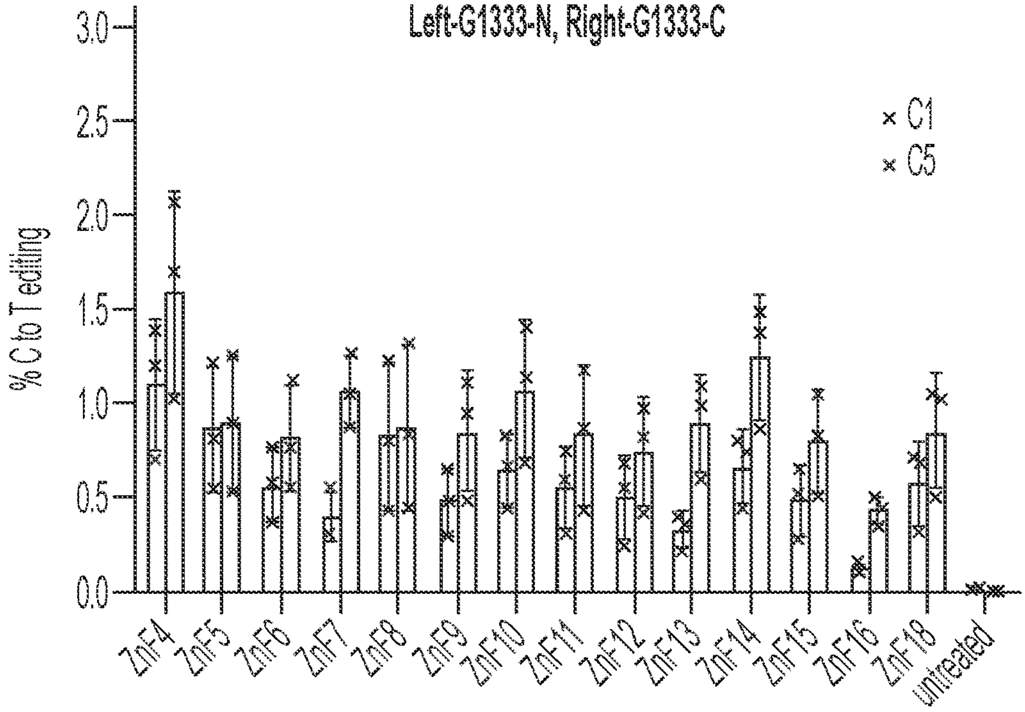
Figure 68B:
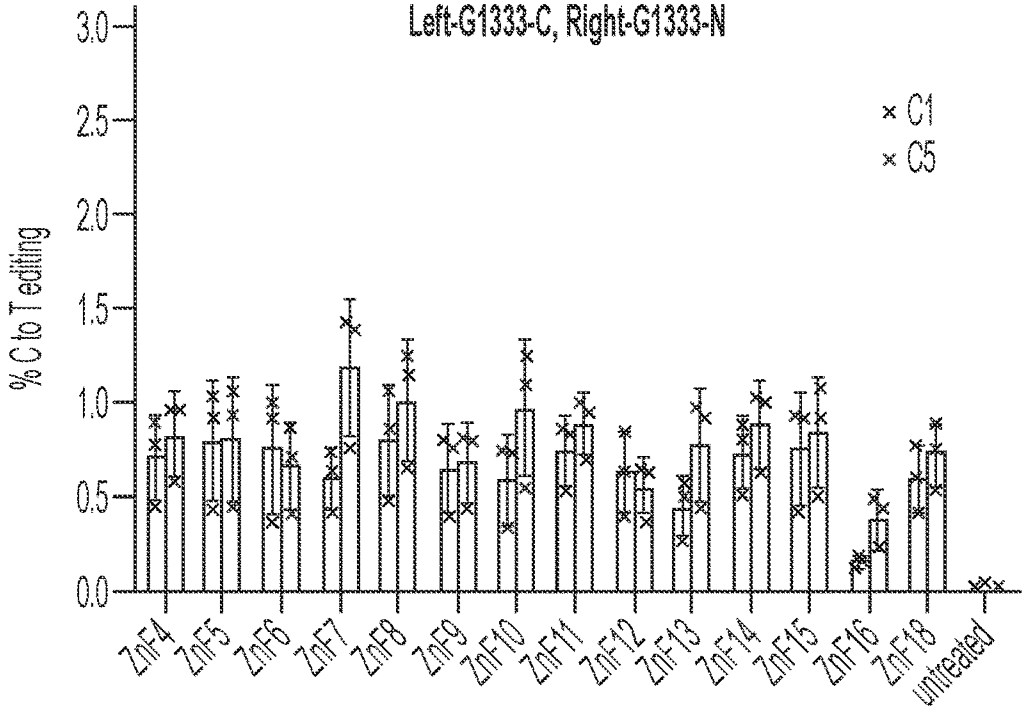
Figure 68C:
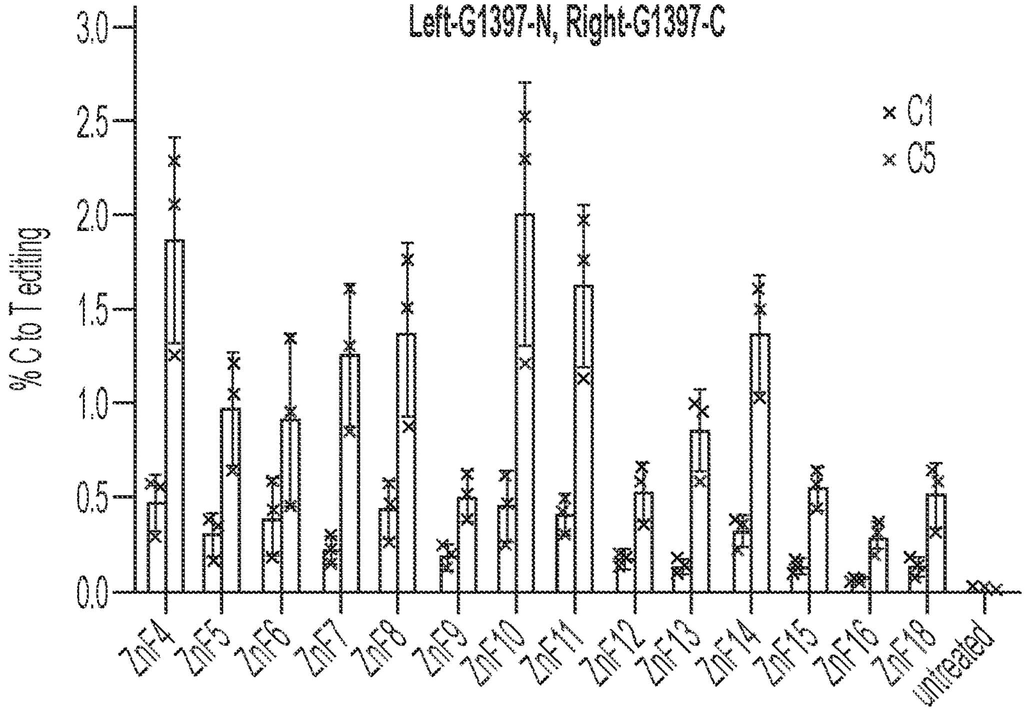
Figure 68D:
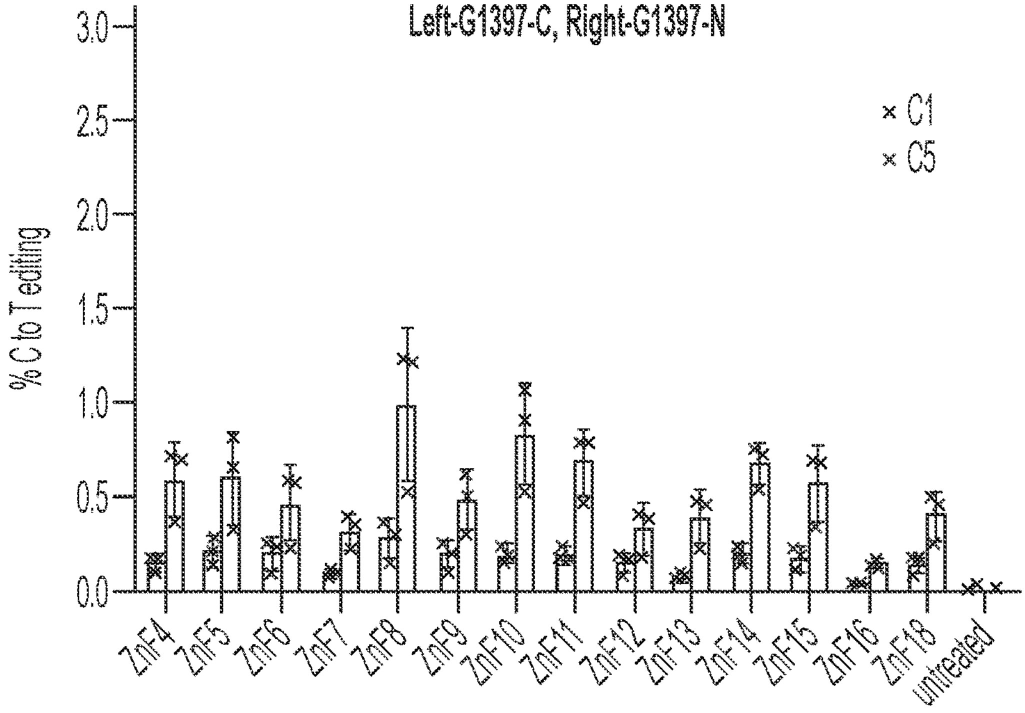

FIG. 67 shows the sequence targeted at site R8 in the human mitochondrial genome by ZFs R8, 5xZnF-4-R8 and 5xZnF-18-R8.

FIGS. 68A-68D show editing activity for various ZFs designed to create a 4-18 bp editing window with ZF-R8.

Figure 69:
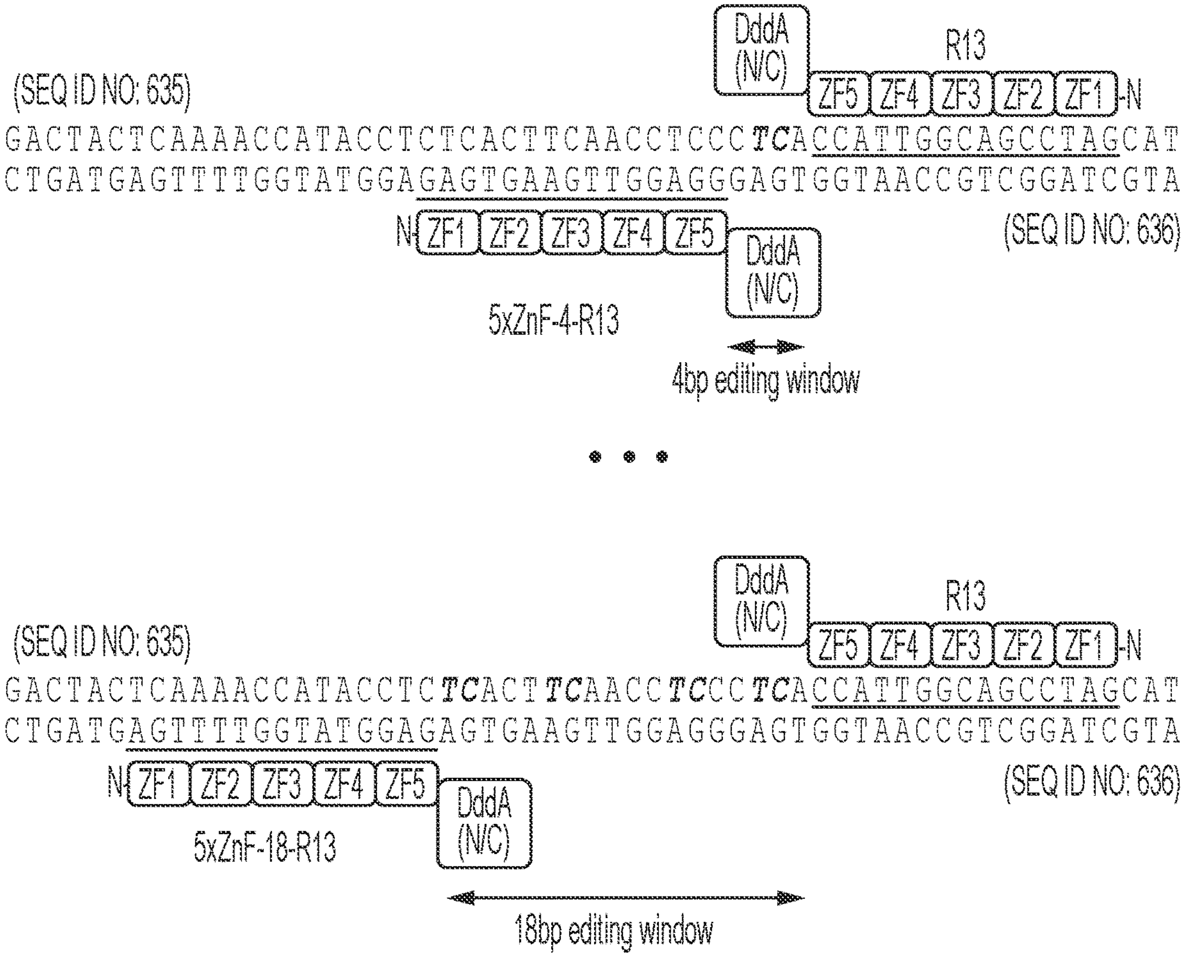
Figure 70A:
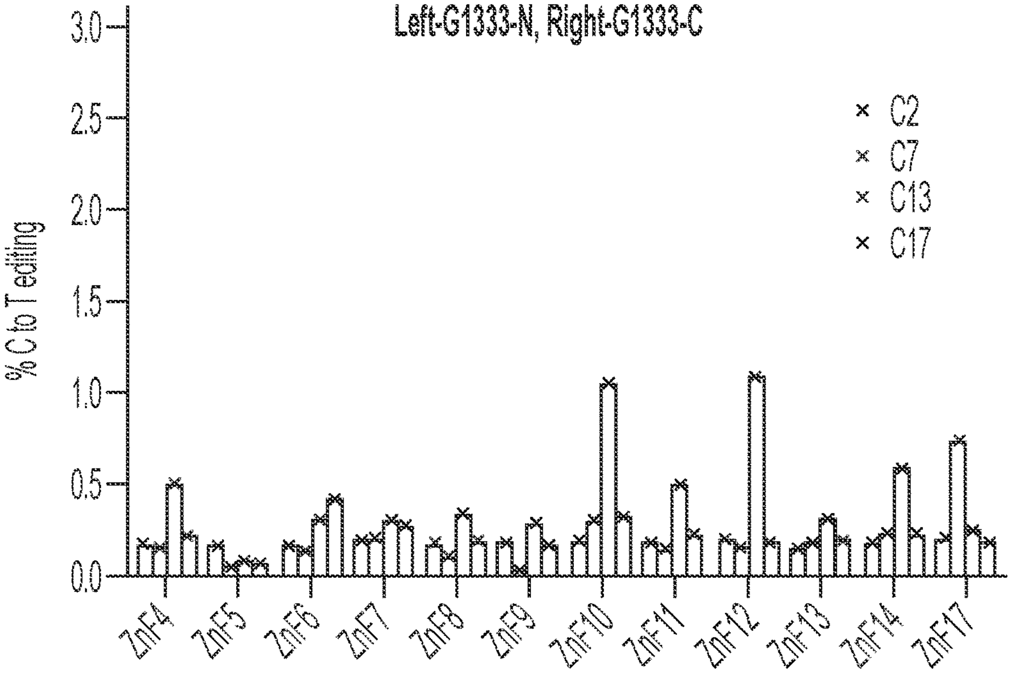
Figure 70B:
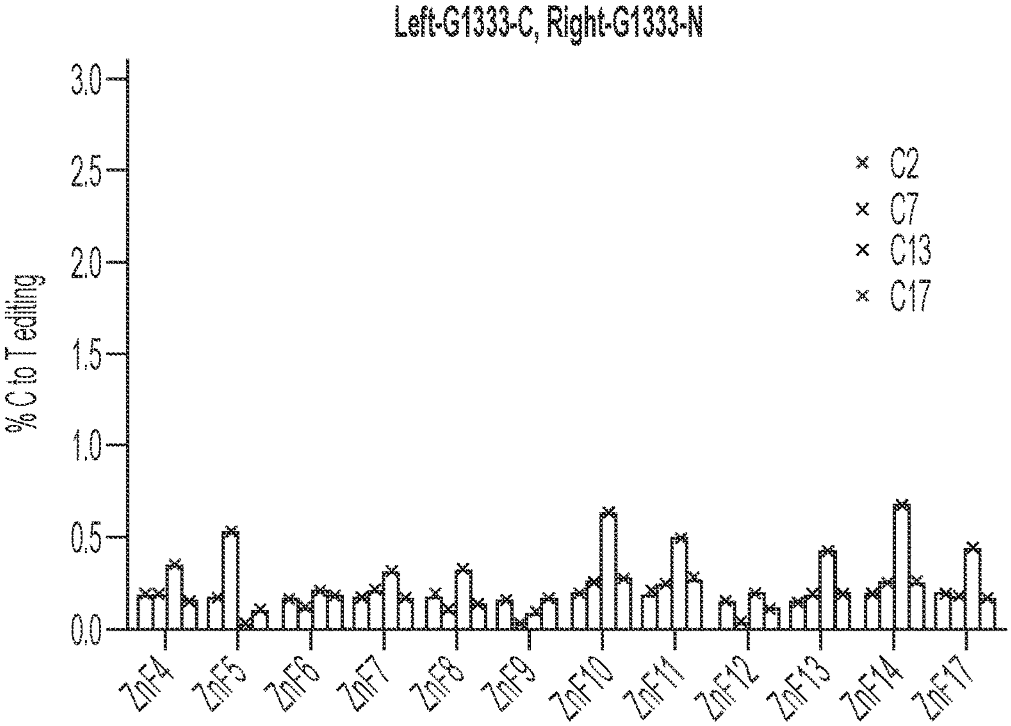
Figure 70C:
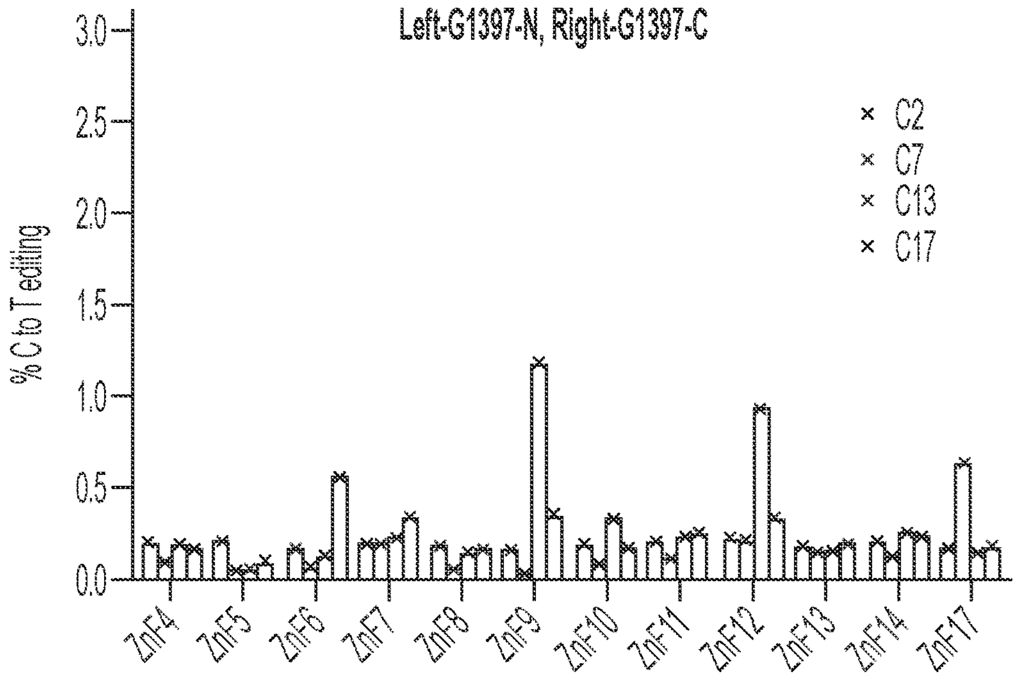
Figure 70D:
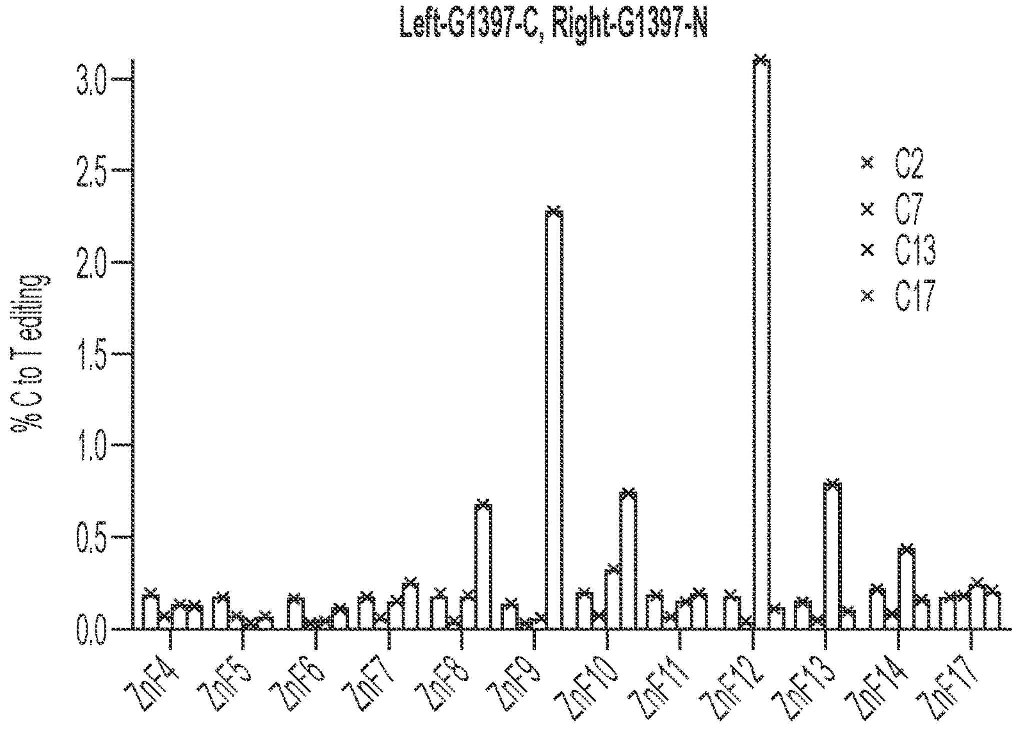

FIG. 69 shows the sequence targeted at site R13 in the human mitochondrial genome by ZFs R 13, 5xZnF-4-R 13 and 5xZnF-18-R13.

FIGS. 70A-70D show editing activity for various ZFs designed to create a 4-18 bp editing window with ZF-R13.

Figures 71A, 71B:
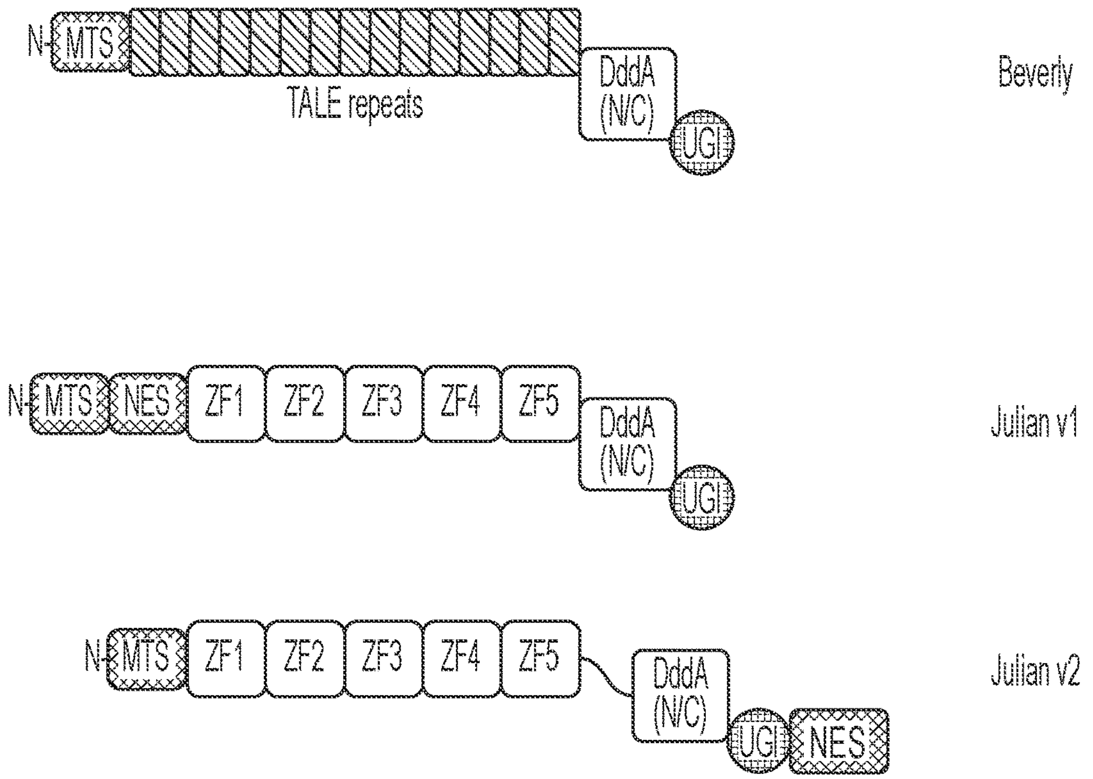

FIGS. 71A-71B show improvements to ZF-BE architecture made in round 2 of optimization.

Figure 72:
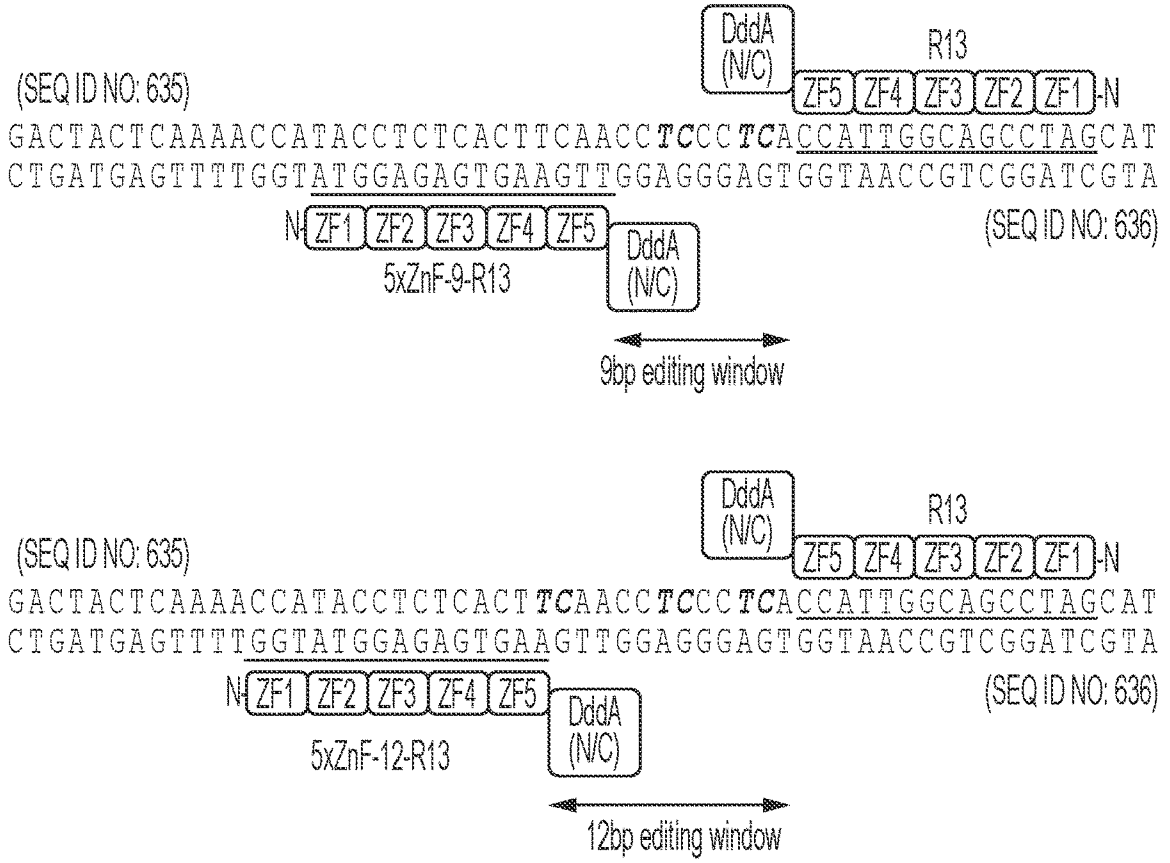

FIG. 72 shows the sequence targeted at site R 13 in the human mitochondrial genome by ZFs R13, 5xZnF-9-R13 and 5xZnF-12-R13.

Figure 73A:
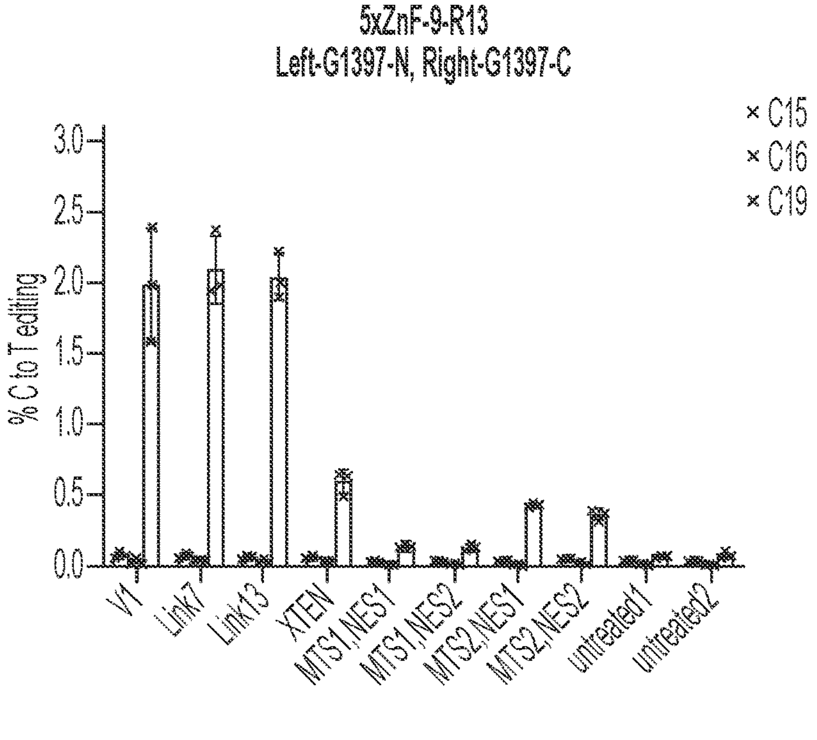
Figure 73B:
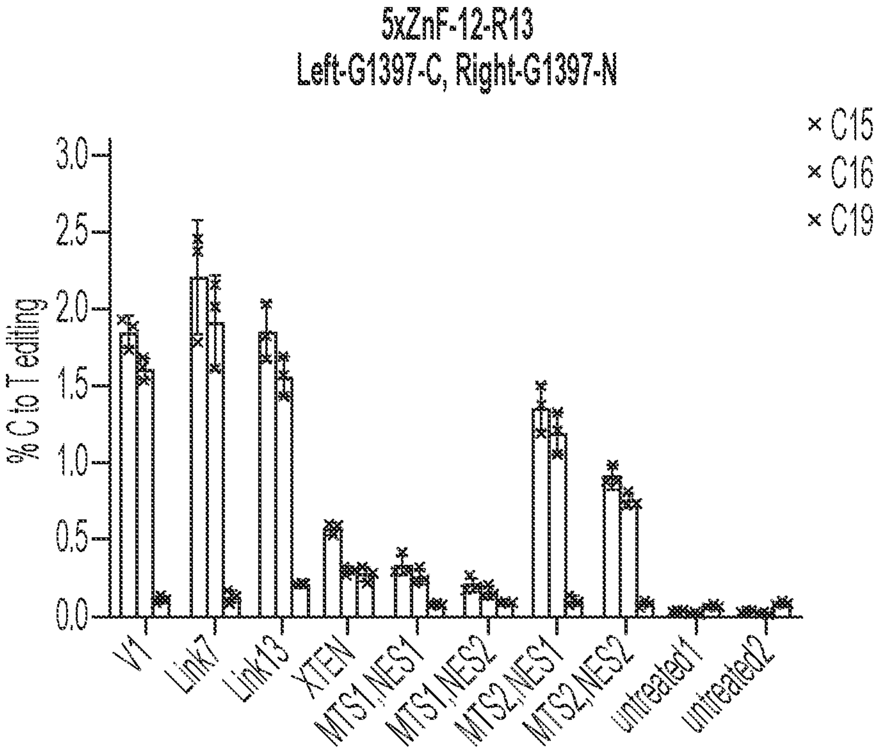

FIGS. 73A-73B show editing activity in human HEK293T cells targeting site R13. Results show the differences in outcomes from using ZF-BE architectures as described in FIG. 71A.

Figure 74:
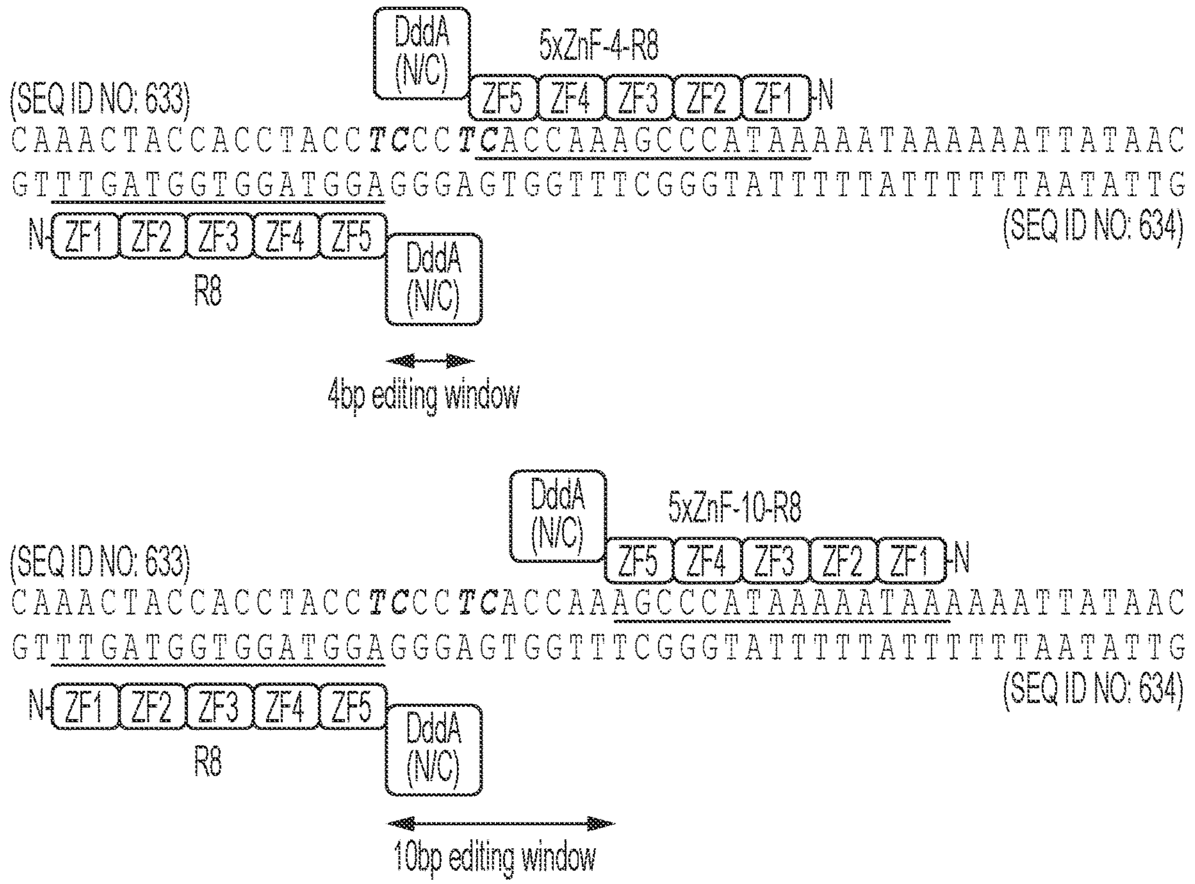

FIG. 74 shows the sequence targeted at site R8 in the human mitochondrial genome by ZFs R8. 5xZnF-4-R8 and 5xZnF-10-R8.

Figure 75A:
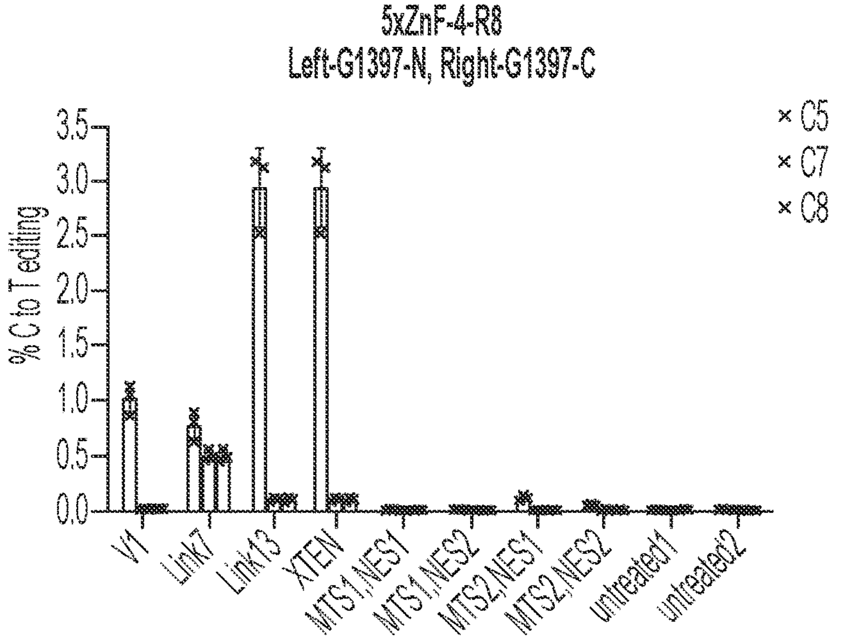
Figure 75B:
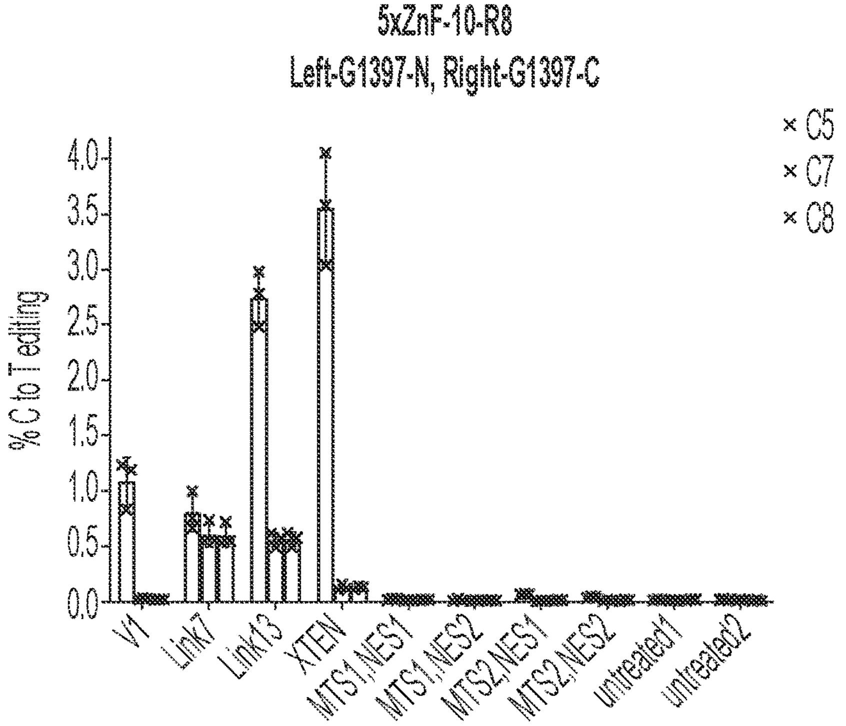

FIGS. 75A-75B editing activity in human HEK293T cells targeting site R8. Results show the differences in outcomes from using ZF-BE architectures as described in FIG. 71A.

Figure 76:
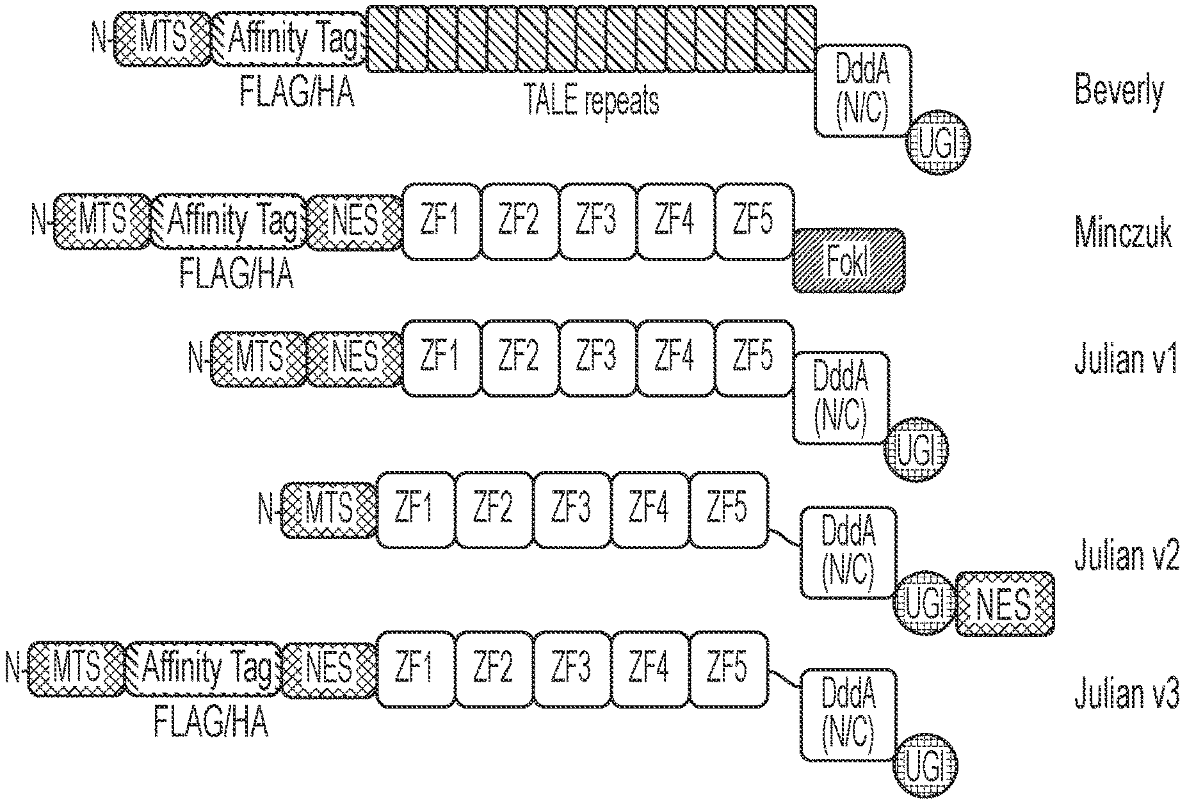
Figure 77A:
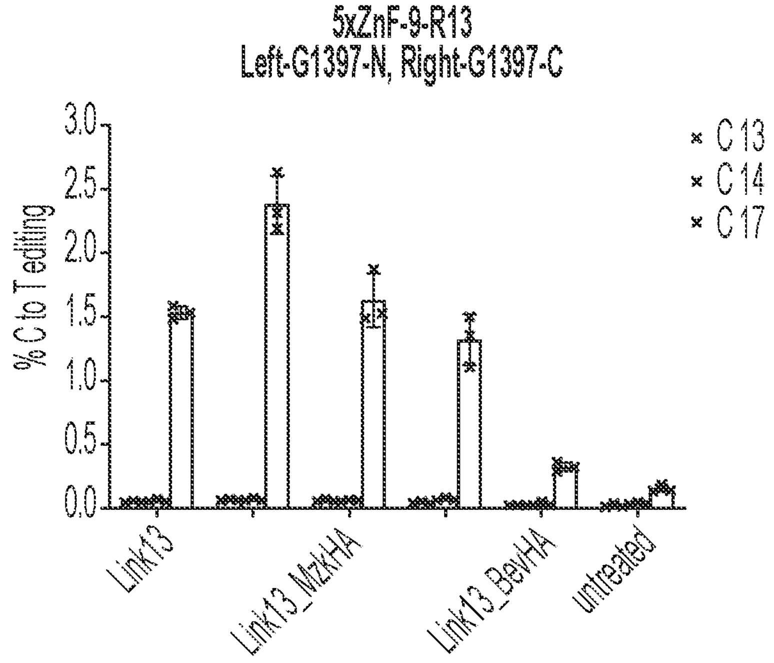
Figure 77B:
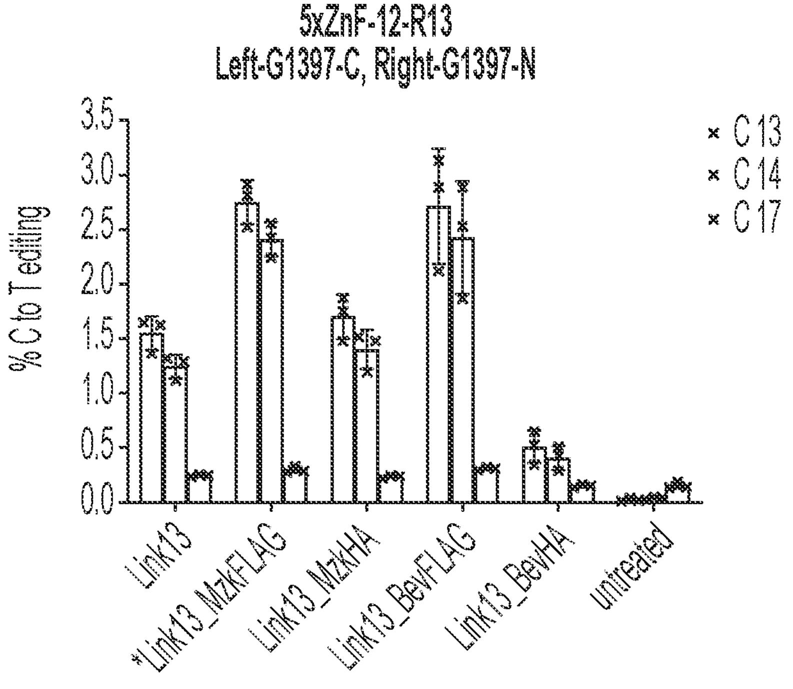
Figure 77C:
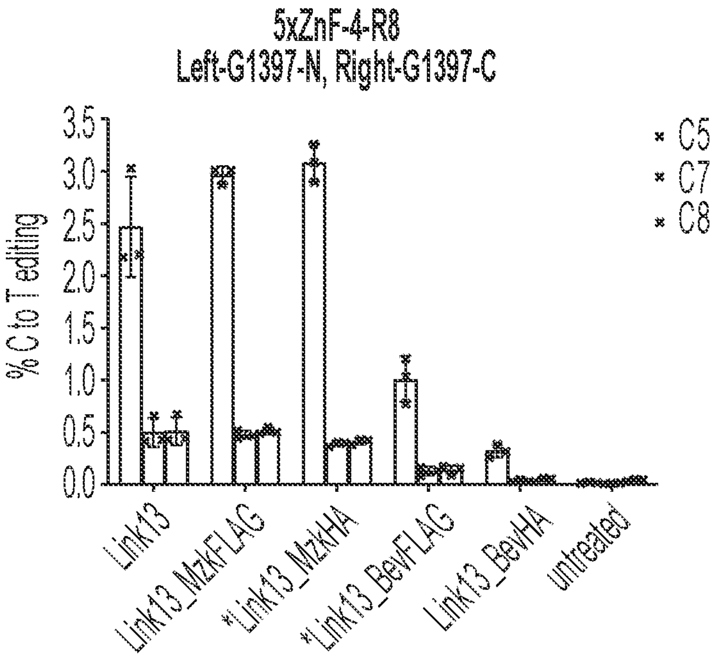
Figure 77D:
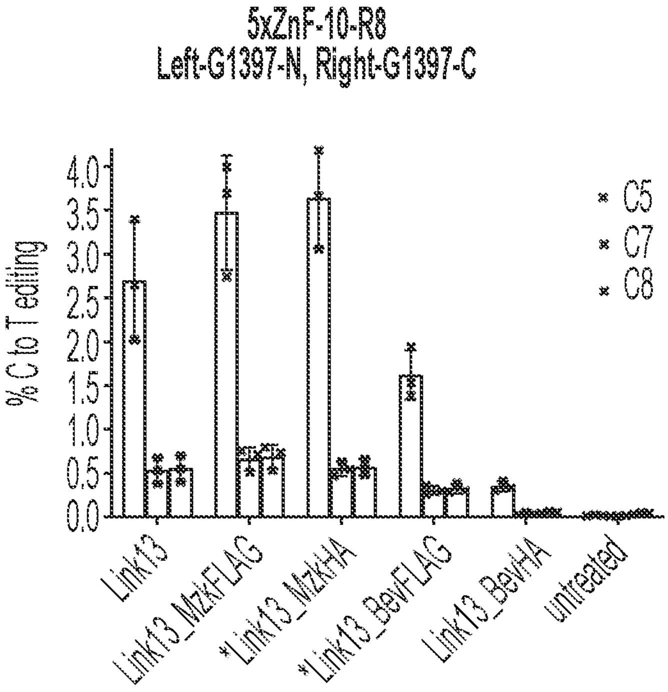

FIG. 76 shows improvements in ZF-BE architecture from round 3 of optimization.

FIGS. 77A-77D show editing activity in human HEK293T cells targeting sites R8 and R13. Results show the differences in outcomes from using ZF-BE architectures as described in FIG. 76.

Figure 78:
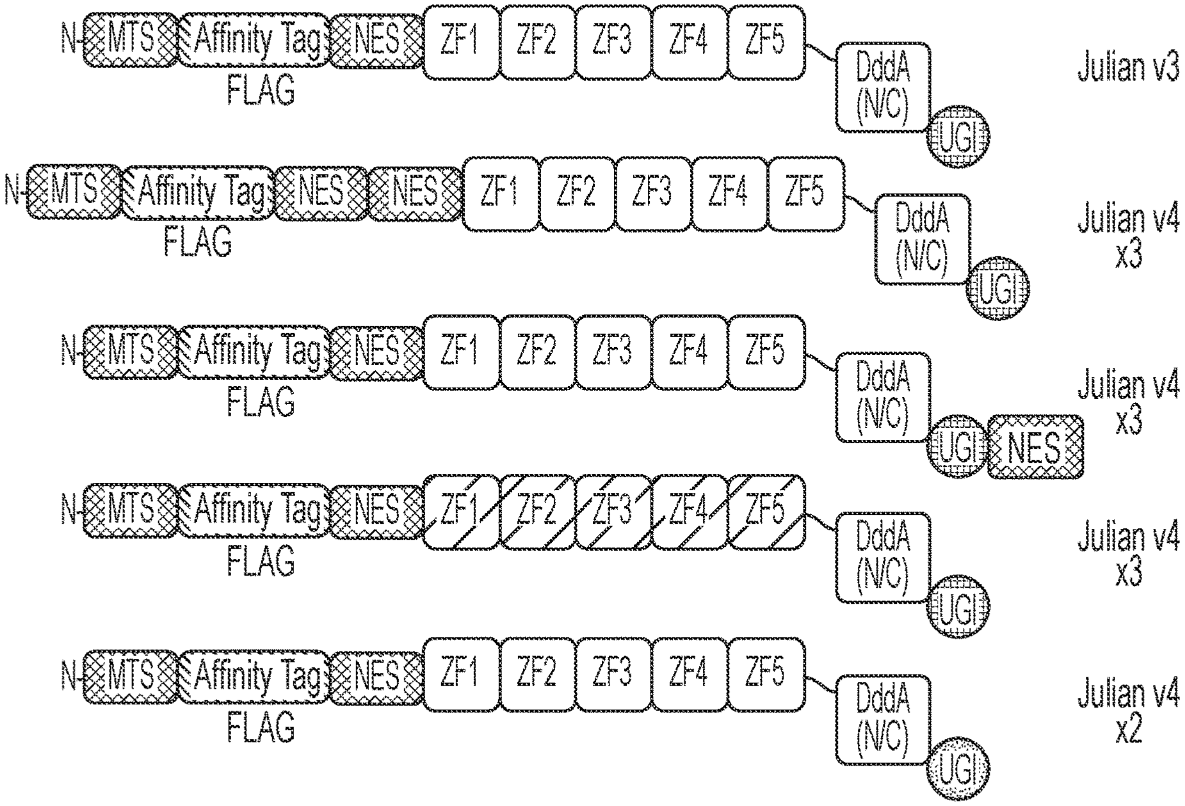
Figure 79A:
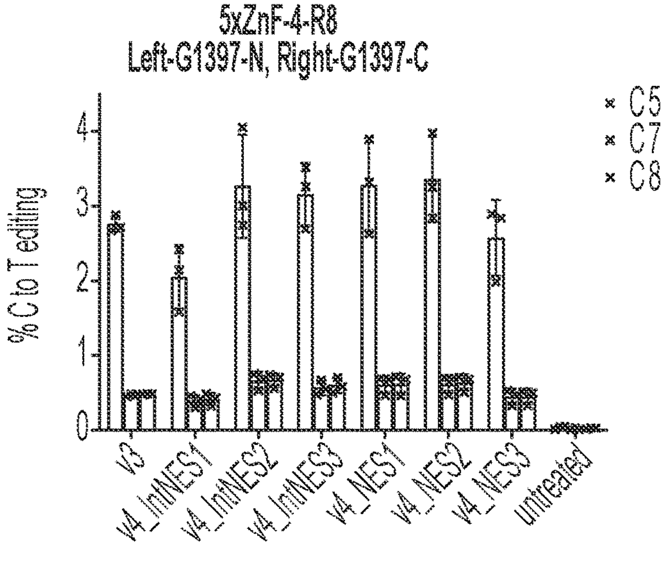
Figure 79B:
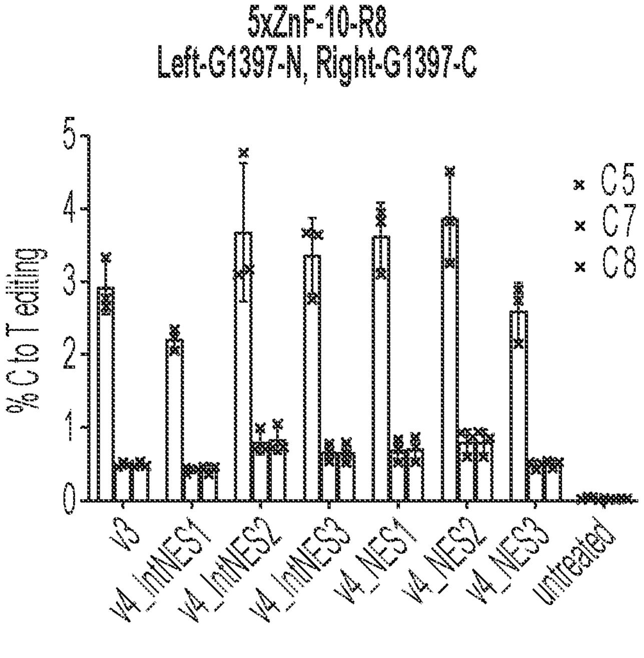
Figure 79C:
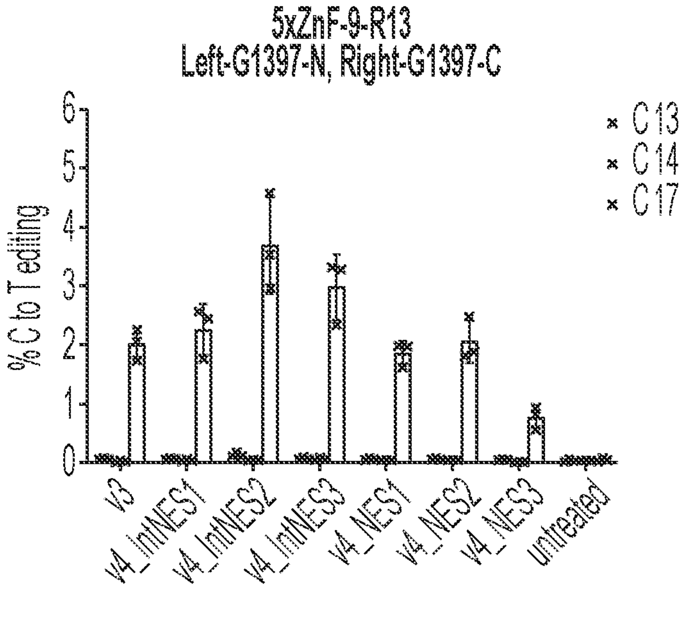
Figure 79D:
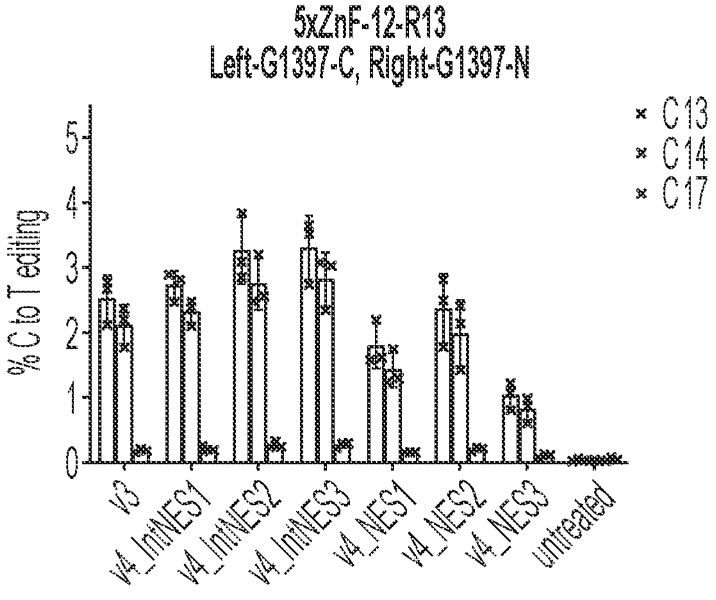
Figure 80A:
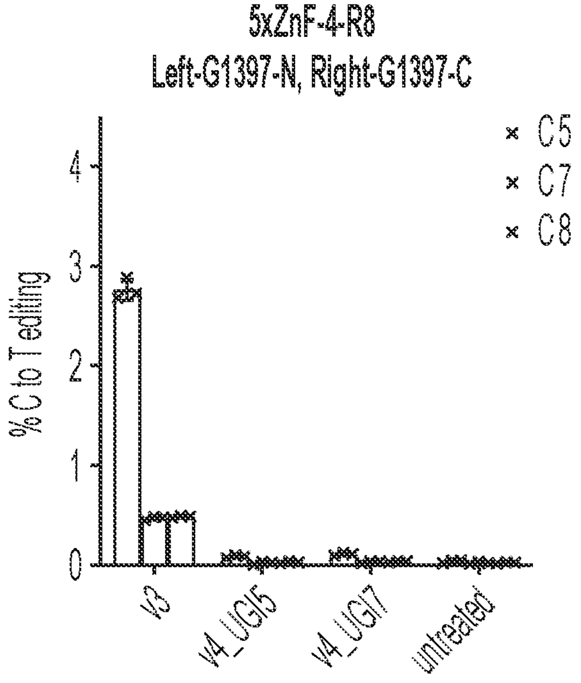
Figure 80B:
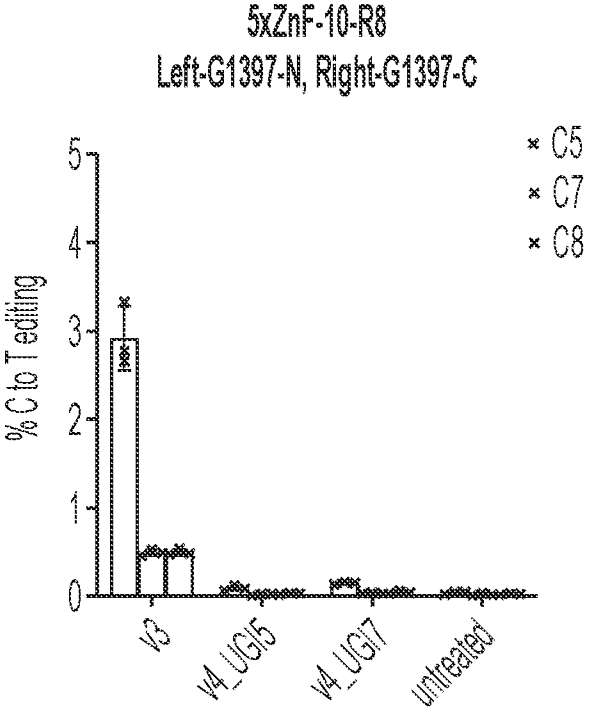
Figure 80C:
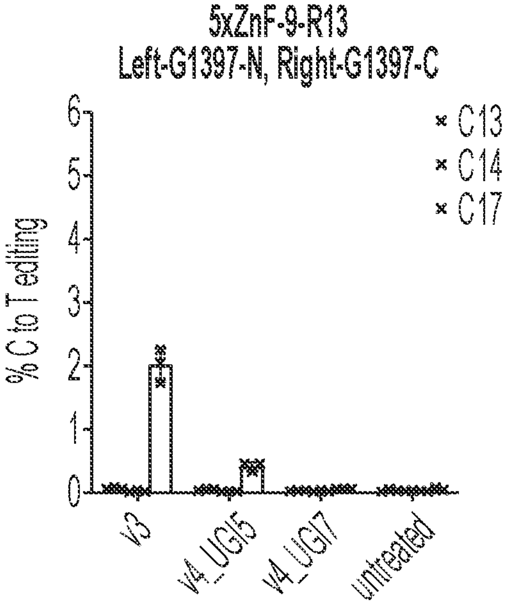
Figure 80D:
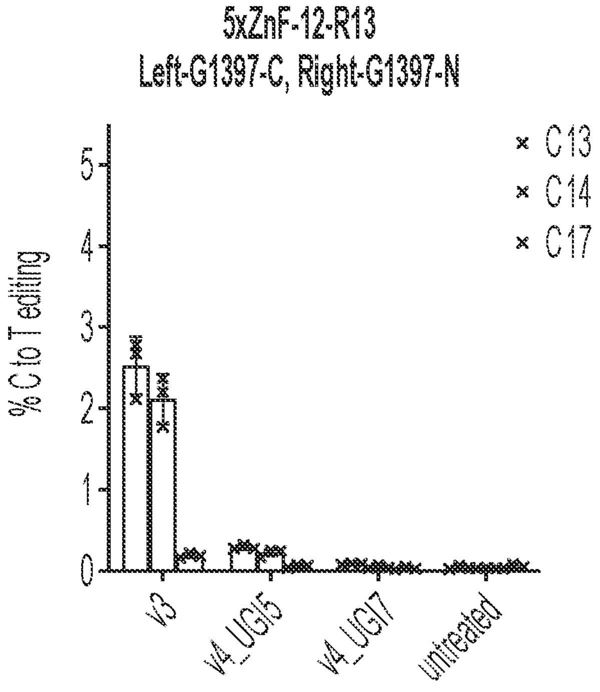

FIG. 78 shows improvements in ZF-BE architecture from round 4 of optimization.

FIGS. 79A-79D show editing activity in human HEK293T cells targeting sites R8 and R 13. Results show the differences in outcomes from using ZF-BE architectures as described in FIG. 78.

FIGS. 80A-80D show editing activity in human HEK293T cells targeting sites R8 and R13. Results show the differences in outcomes from using modified UGI homologs in ZF-BE architectures as described in FIG. 76.

Figure 81A:
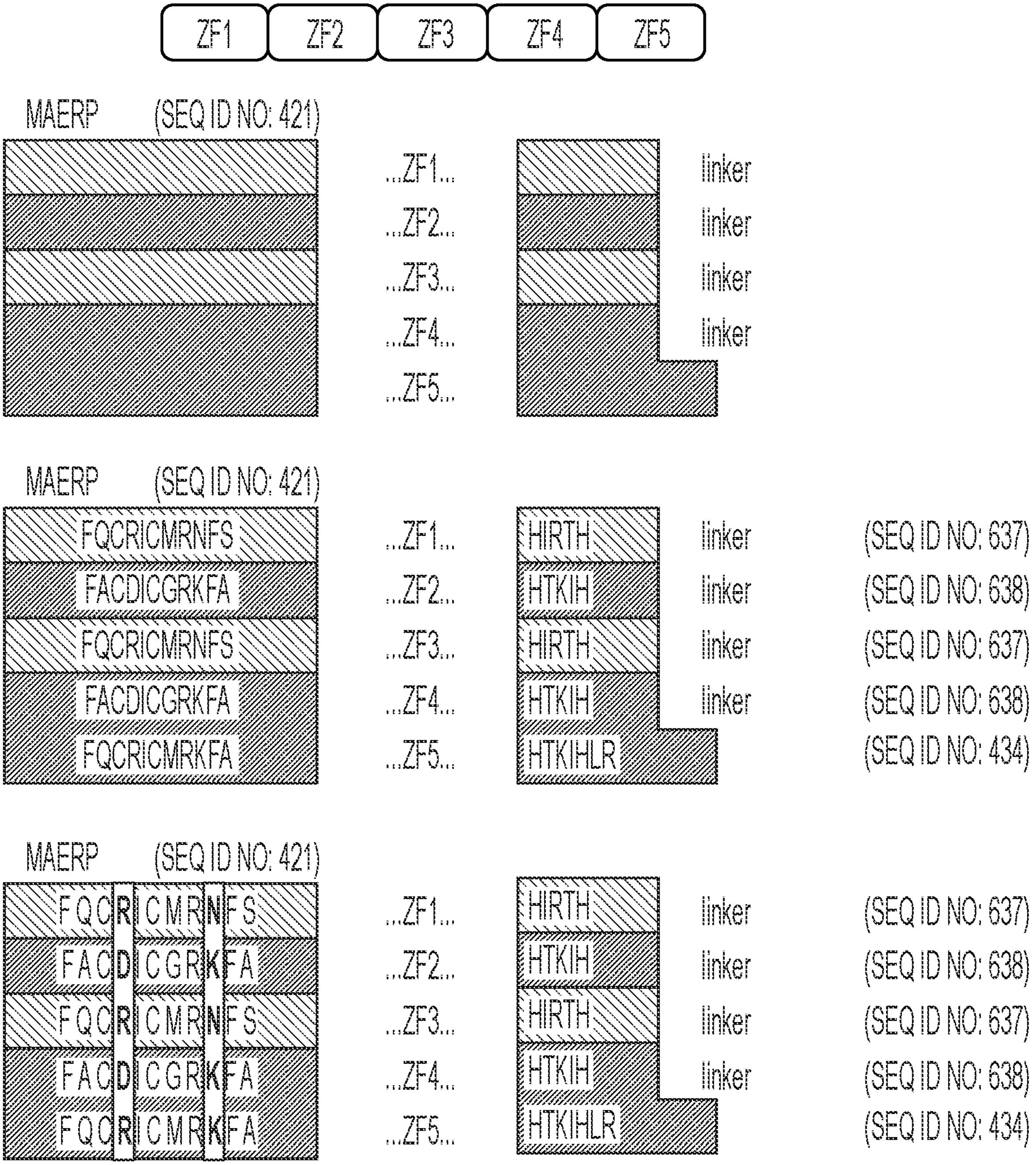
Figure 81B:
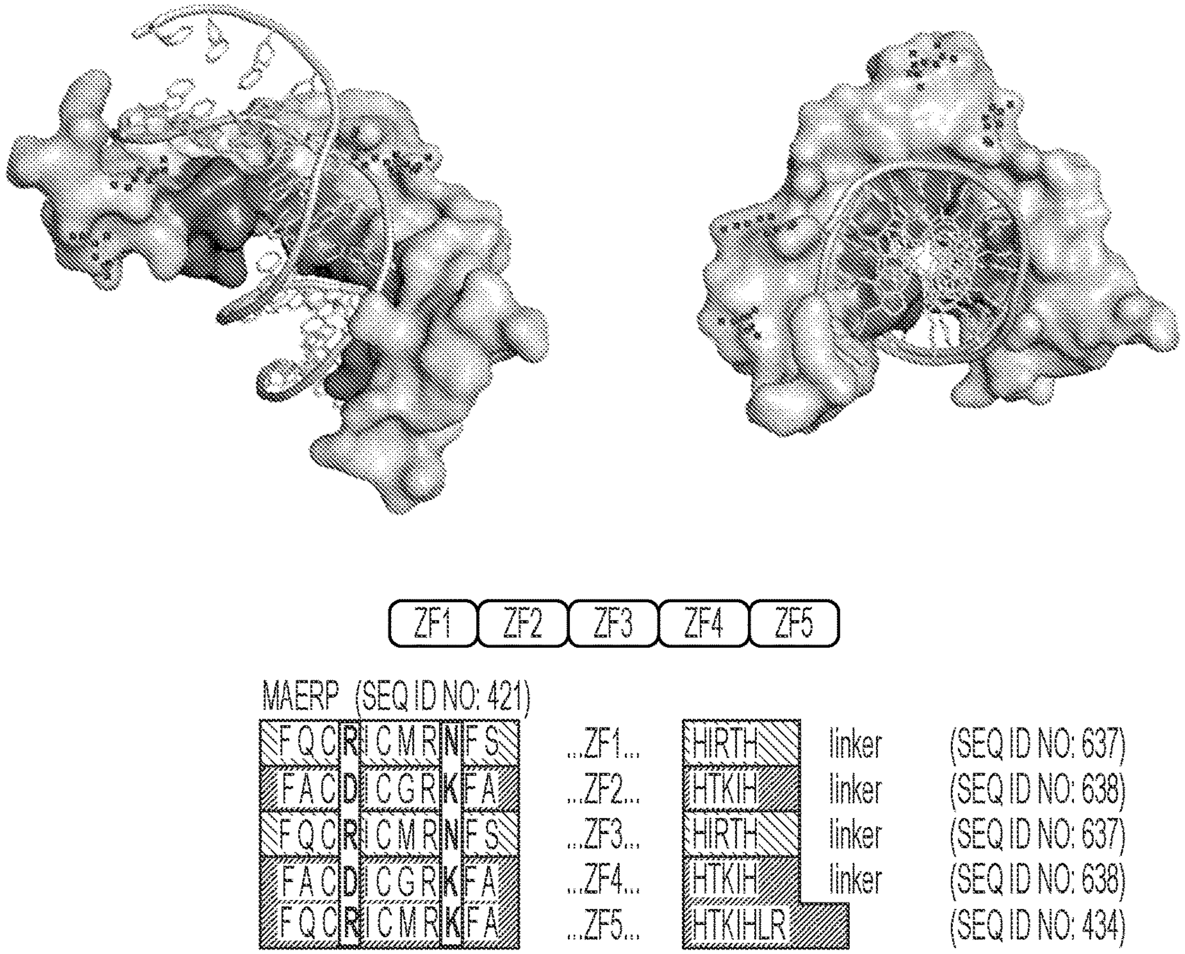
Figure 81C:
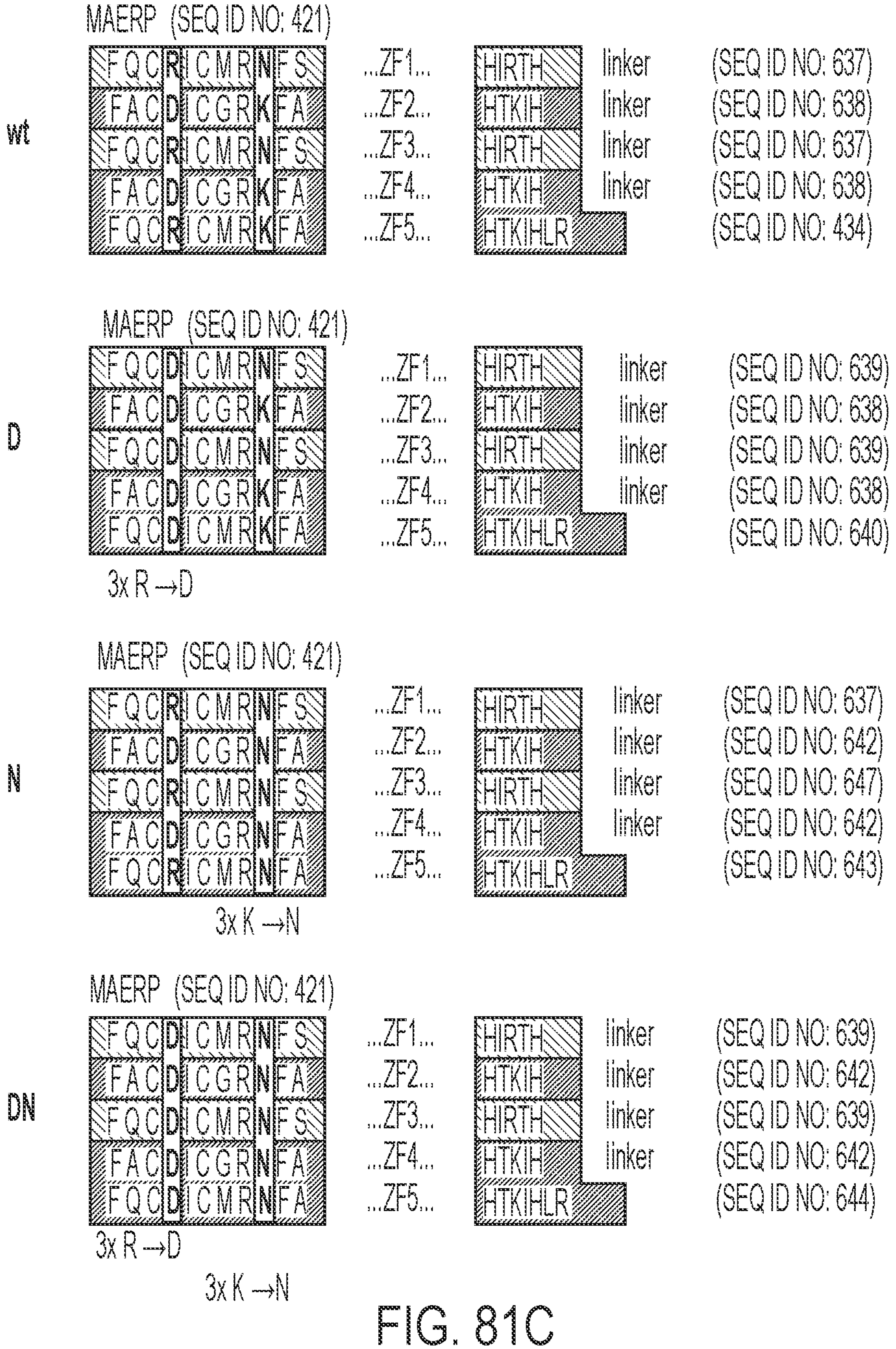
Figure 82A:
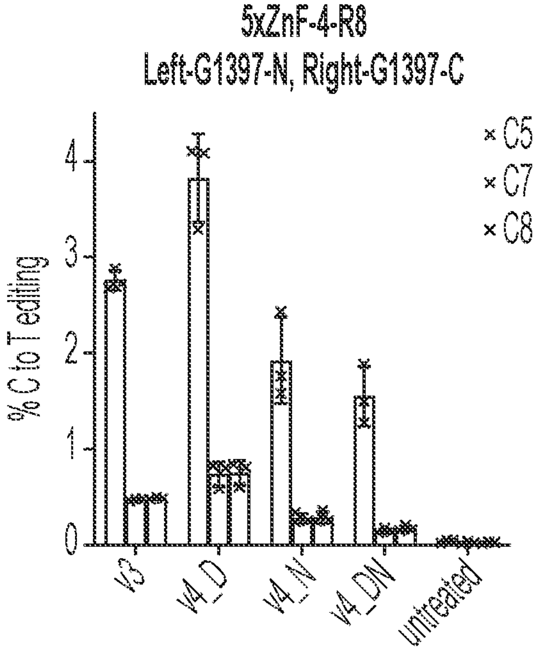
Figure 82B:
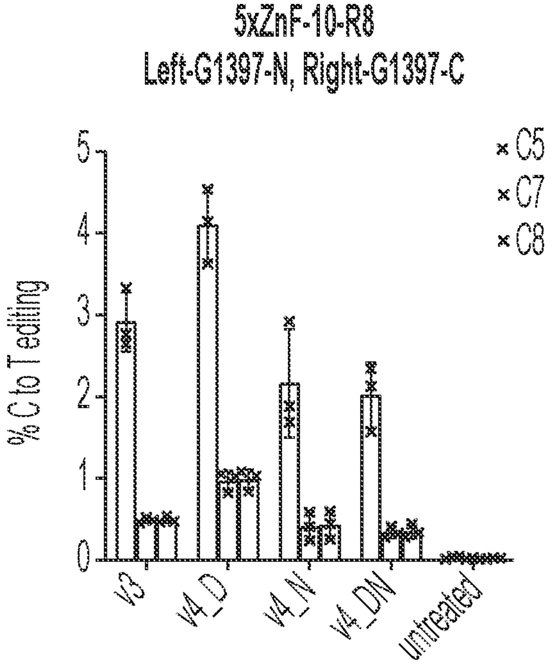
Figure 82C:
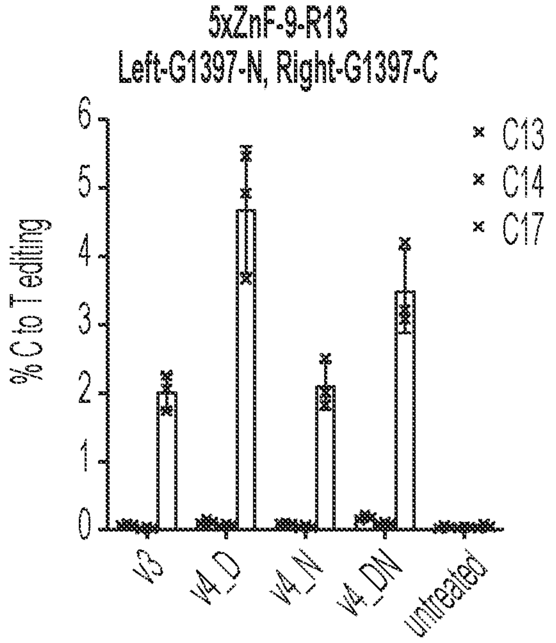
Figure 82D:
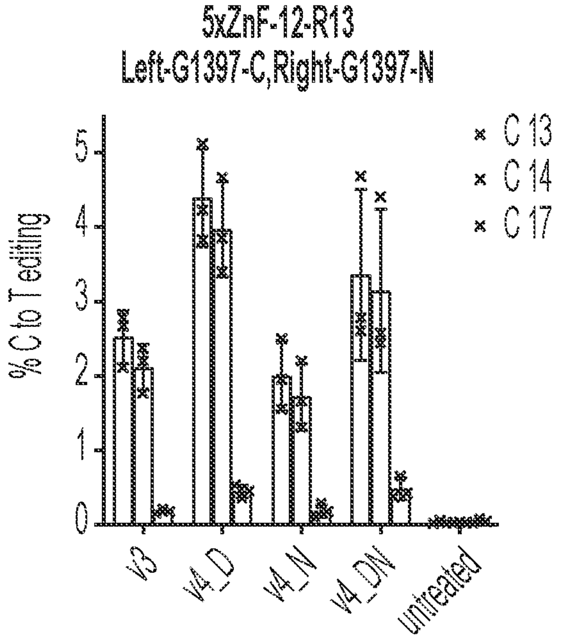

FIGS. 81A-81C show exemplary ZF scaffolds with non-conserved positively charged residues in bold. FIG. 81C shows mutations used in round 4 of optimization.

FIGS. 82A-82D show editing activity in human HEK293T cells targeting sites R8 and R13. Results show the differences in outcomes in mutated ZF scaffolds from using ZF-BE architectures as described in FIG. 78.

Figure 83:
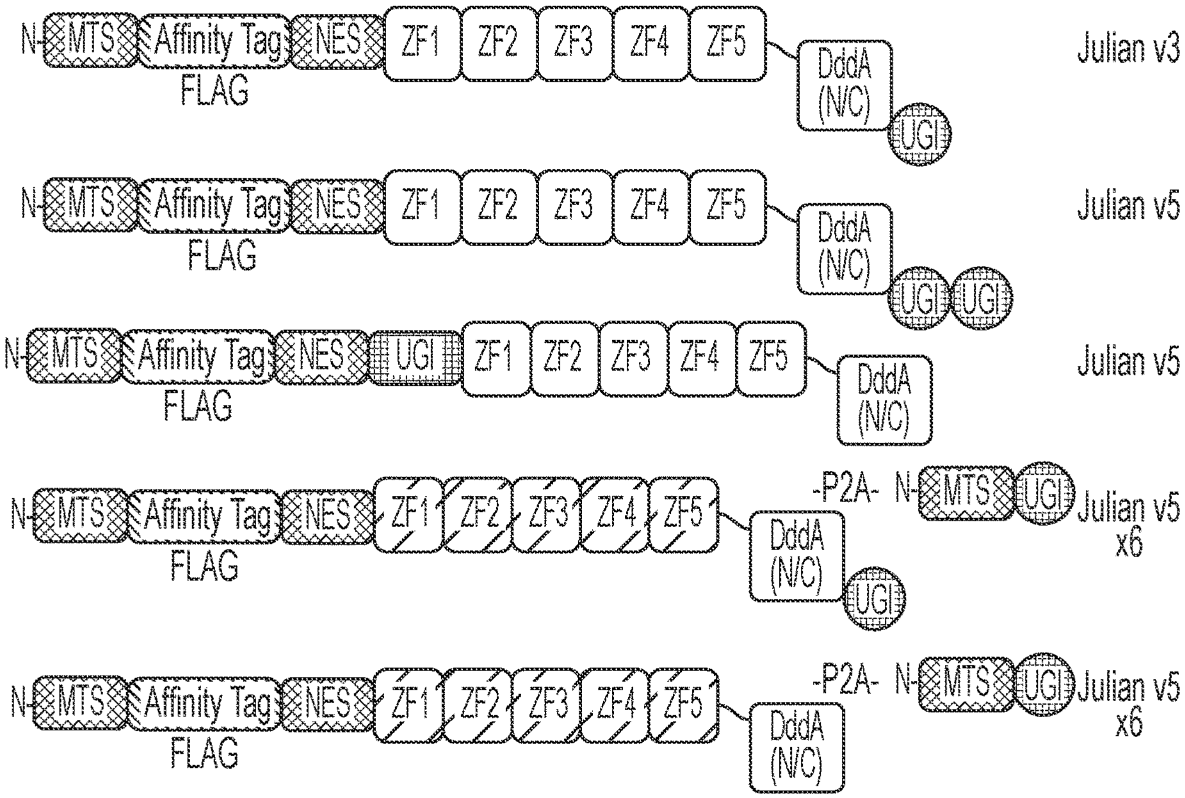
Figure 84A:
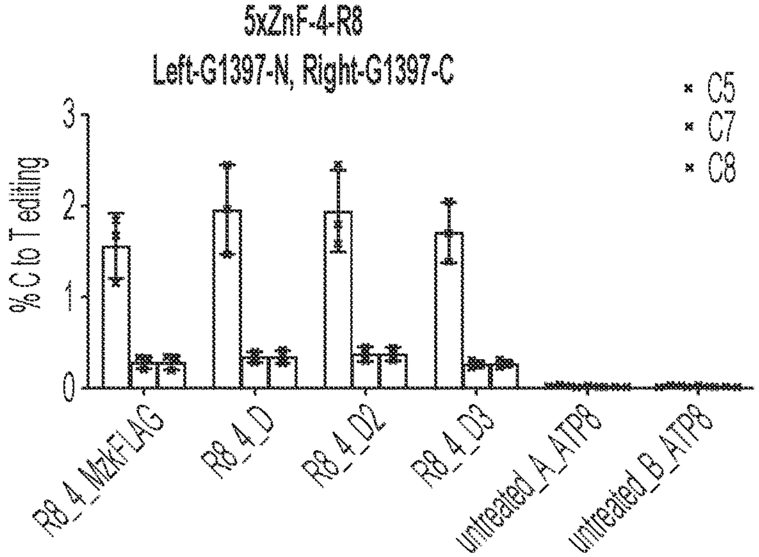
Figure 84B:
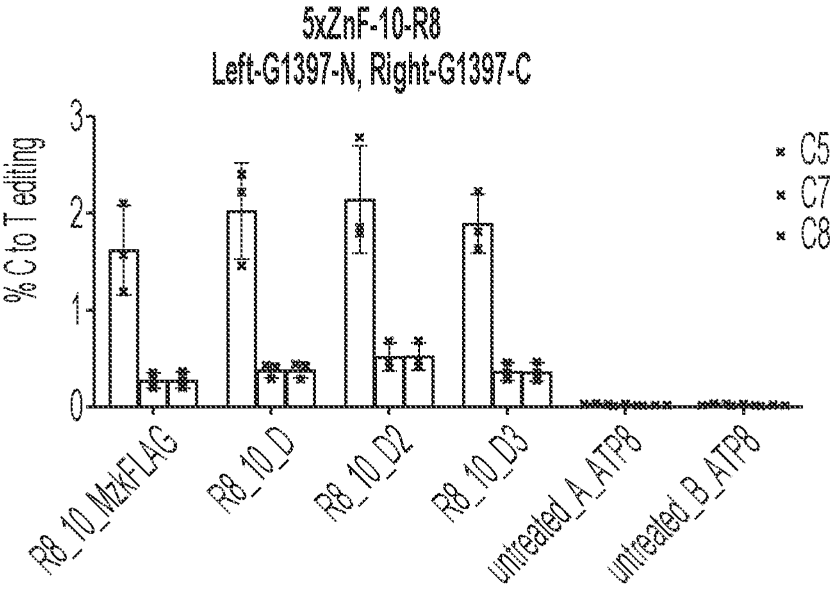
Figure 84C:
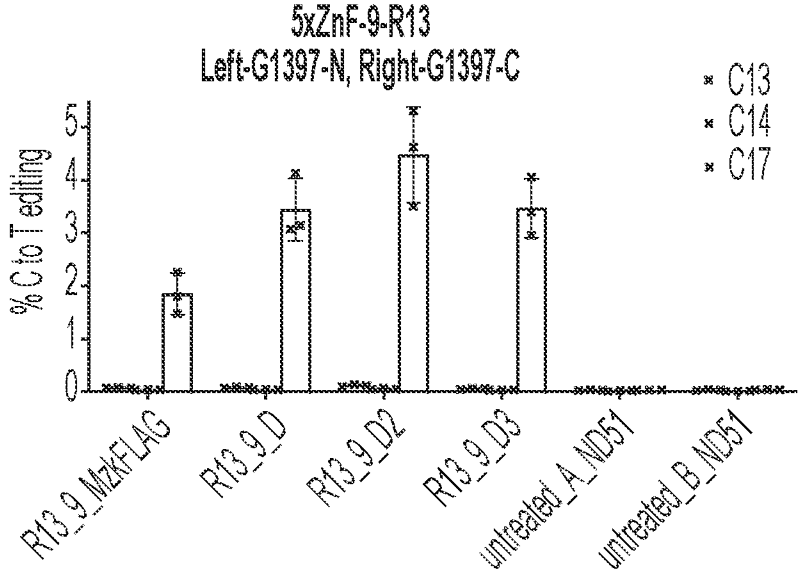
Figure 84D:
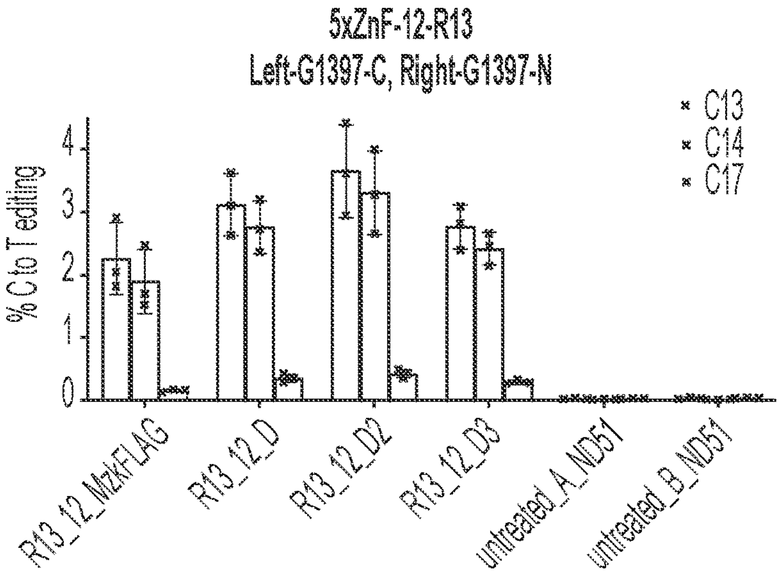
Figure 85A:
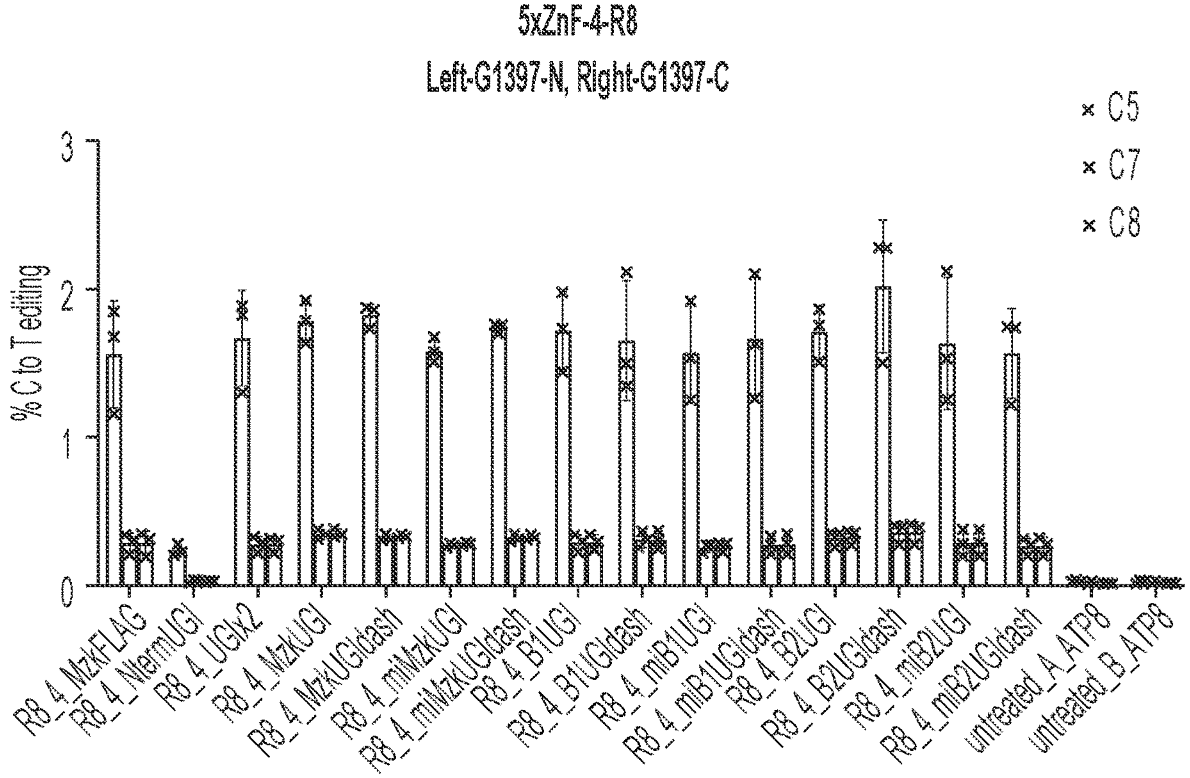
Figure 85B:
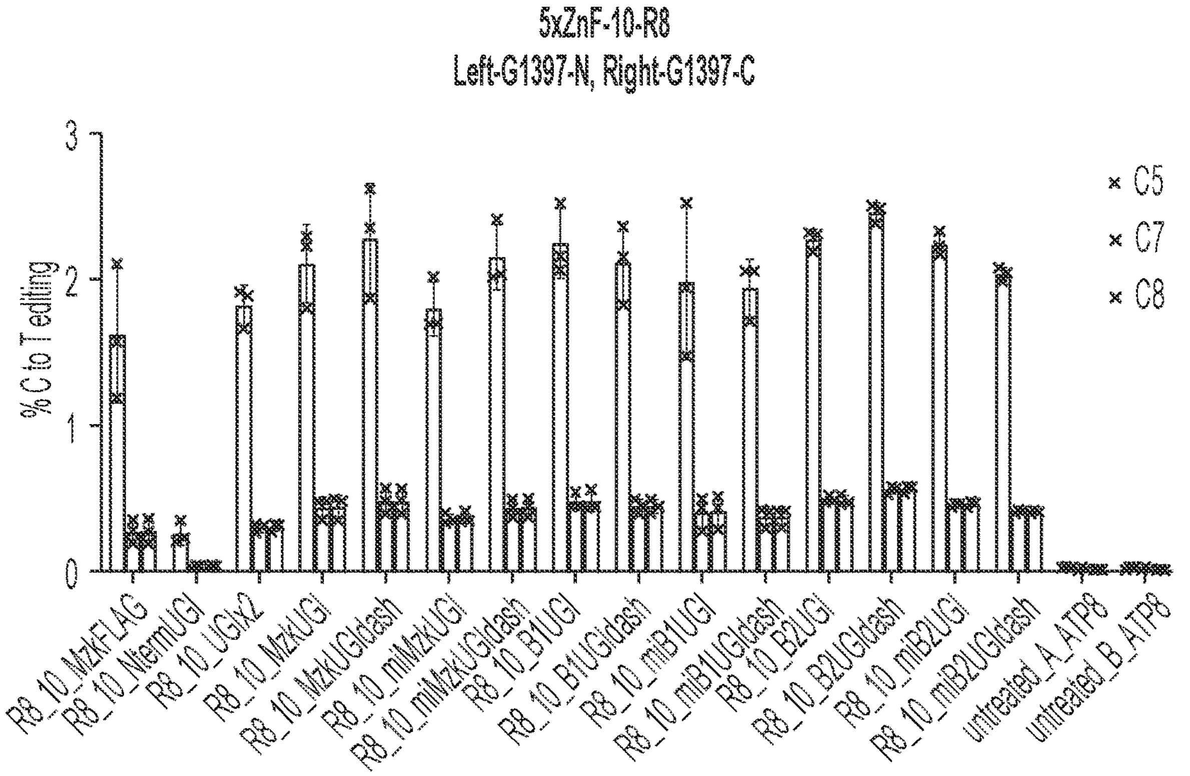
Figure 85C:
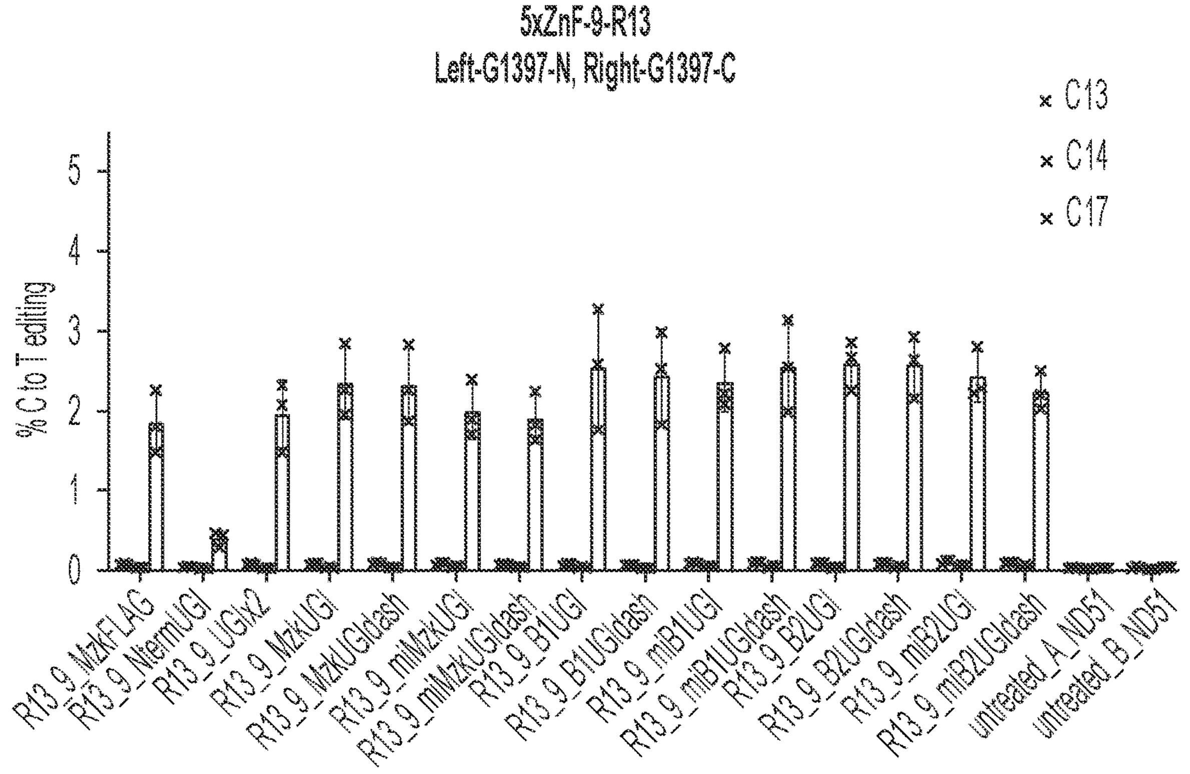
Figure 85D:
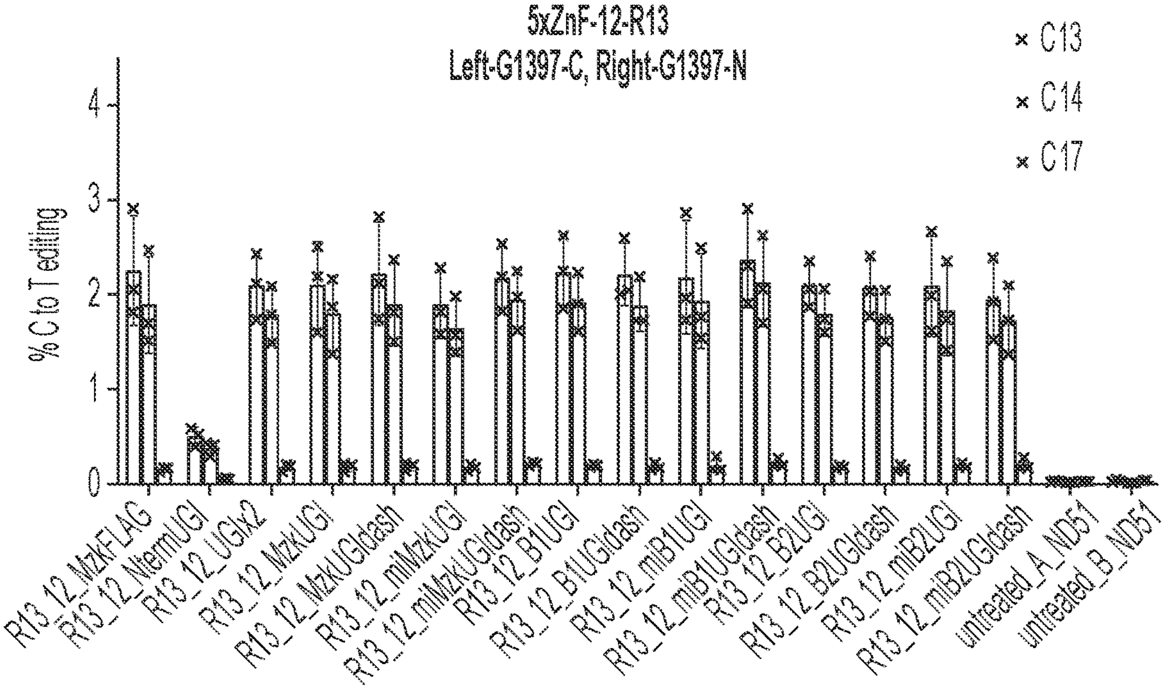

FIG. 83 shows the improvements in ZF-BE architecture from round 5 of optimization.

FIGS. 84A-84D show editing activity in human HEK293T cells targeting sites R8 and R13. Results show the differences in outcomes from using ZF-BE architectures as described in FIG. 83.

FIGS. 85A-85D show editing activity in human HEK293T cells targeting sites R8 and R 13. Results show the differences in outcomes from using ZF-BE architectures as described in FIG. 83.

Figure 86:
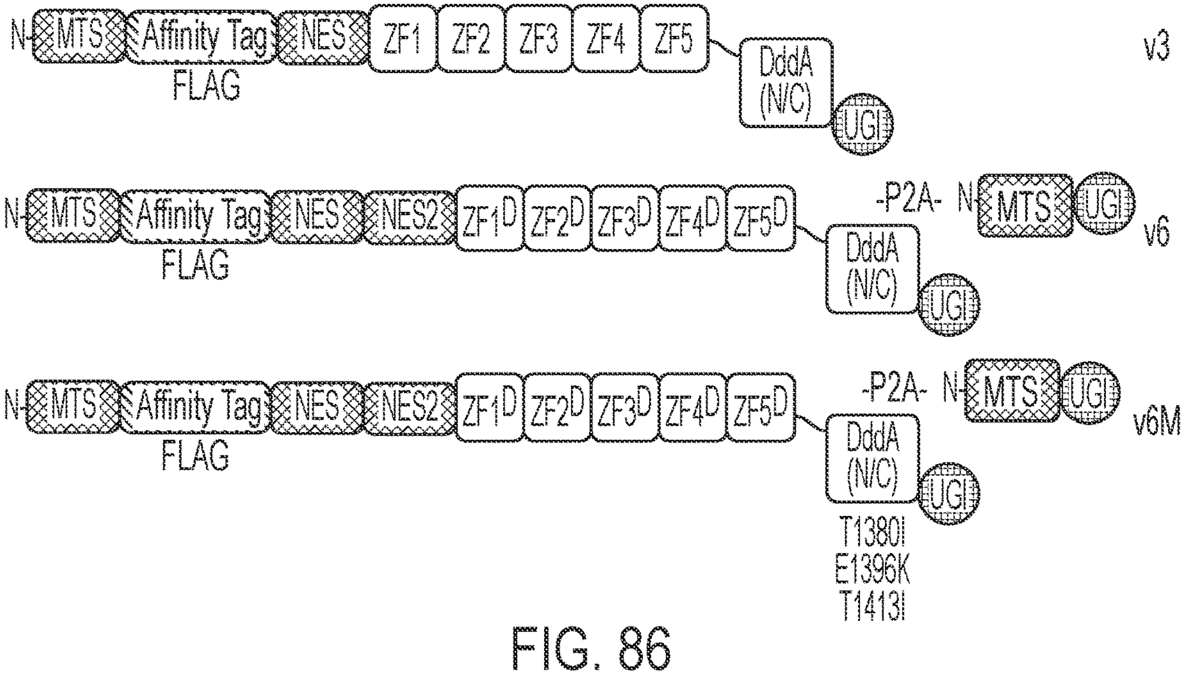

FIG. 86 shows the improvements in ZF-BE architecture from rounds of optimization. v6 differs from v3 in the inclusion of an additional NES, improvement of the ZF scaffold sequence, and coexpression of a separate mitochondrially-targeted UGI. v6M differs from v6 in the inclusion of mutations T1380I, E1396K and T14131 into the split DddA deaminase halves.

Figure 87A:
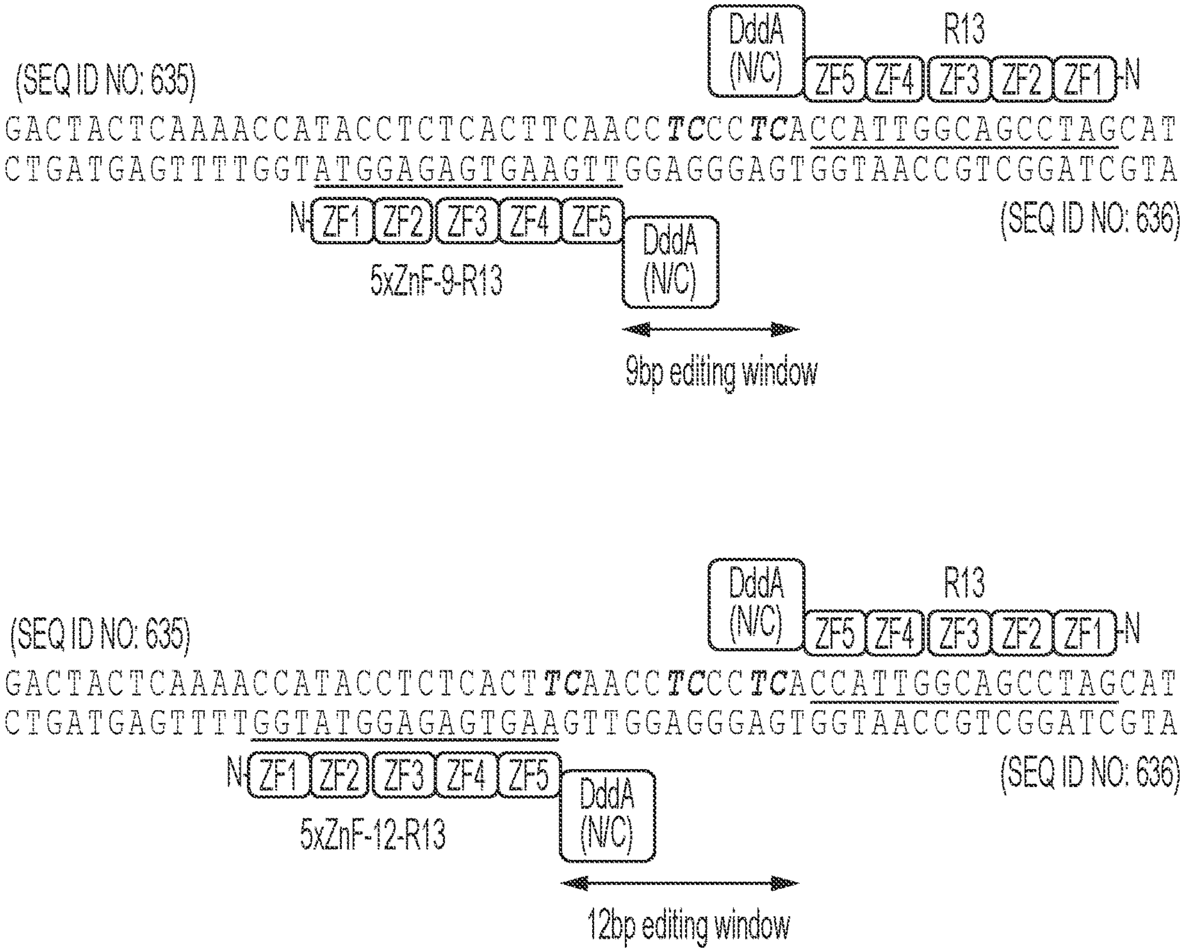
Figure 87B:
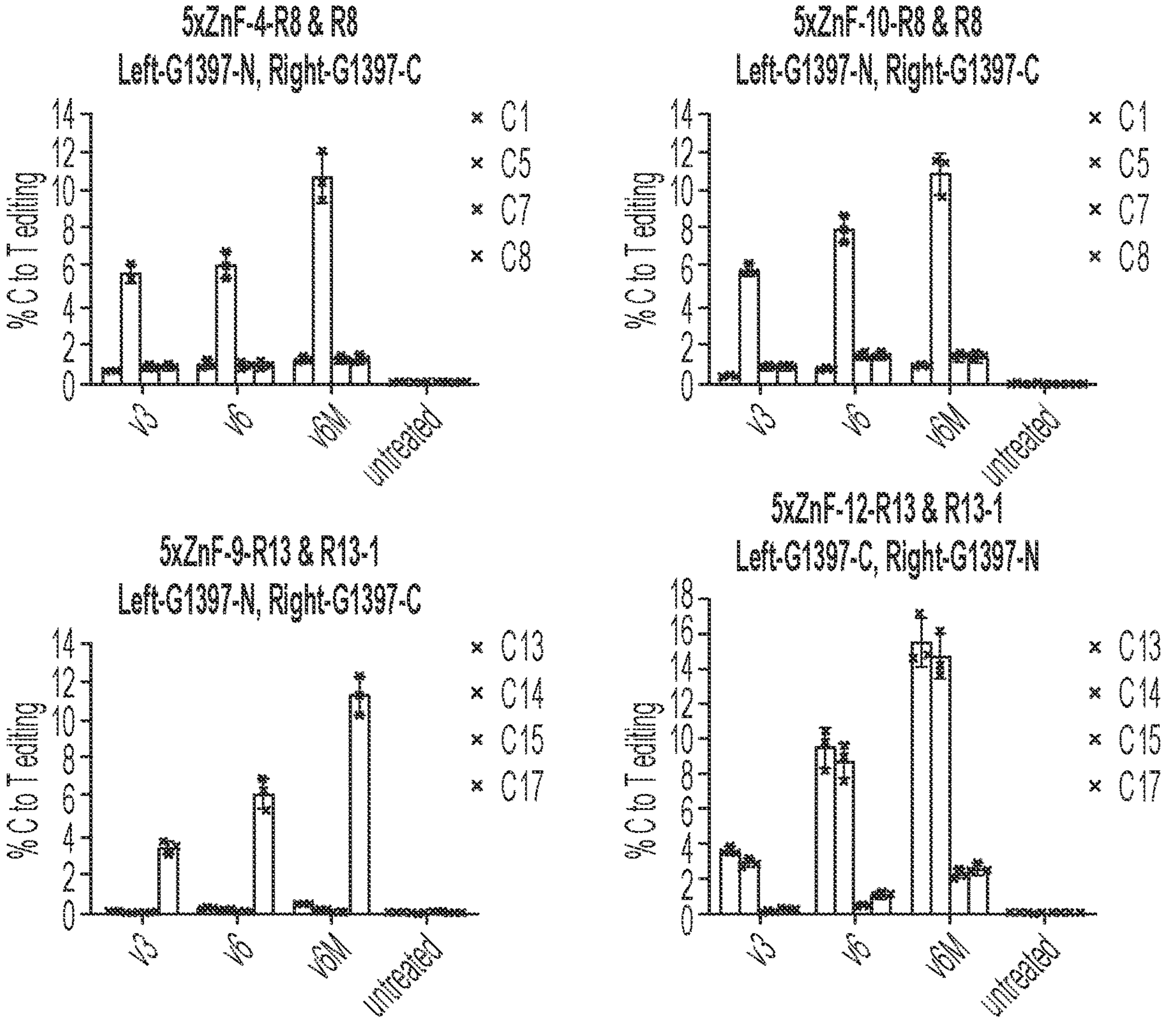

FIGS. 87A-87B show the sequence targeted at site R13 in the human mitochondrial genome by ZFs R 13-1, 5xZnF-9-R 13 and 5xZnF-12-R13-1 (FIG. 87A), and editing activity of ZF-BEs in human HEK293T cells targeting sites R8 and R13 three days post-transfection (FIG. 87B). Results show the differences in outcomes from using ZF-BE architectures as described in FIG. 86.

Figure 88:
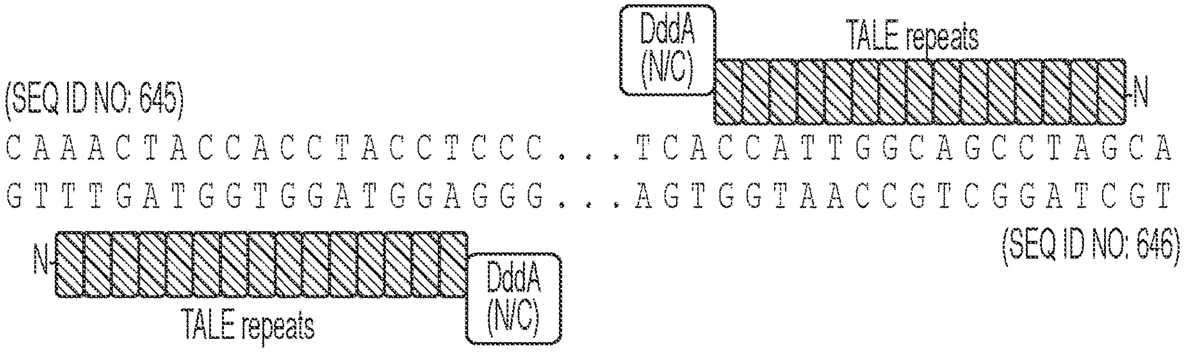

FIG. 88 is an exemplary schematic showing a TALE-DdCBE target for alternative UGI homologs.

Figure 89:
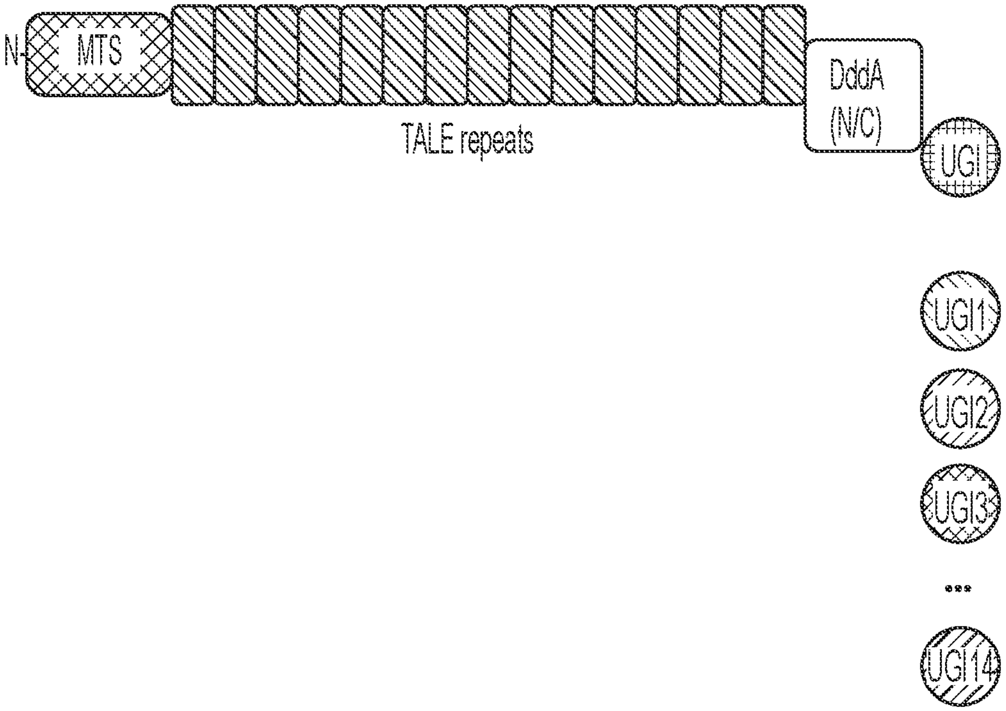

FIG. 89 is a schematic showing the experimental design for testing alternative UGI homologs.

FIGS. 90A-90D show editing activity of TALE-DdCBEs in human HEK293T cells targeting sites ND4, ND5.1 and ATP8 three days post-transfection. Results show the differences in outcomes from using different UGI homologs in comparison against the canonical UGI sequence from bacteriophage PBS2 (UGIcontrol).

FIGS. 91A-91D show results of alternative UGI homolog testing in BE4max.

DEFINITIONS

As used herein and in the claims, the singular forms "a," "an," and "the" include the singular and the plural reference unless the context clearly indicates otherwise. Thus, for example, a reference to "an agent" includes a single agent and a plurality of such agents.

AAV

An "adeno-associated virus" or "AAV" is a virus which infects humans and some other primate species. The wild-type AAV genome is a single-stranded deoxyribonucleic acid (ssDNA), either positive- or negative-sensed. The genome comprises two inverted terminal repeats (ITRs), one at each end of the DNA strand, and two open reading frames (ORFs): rep and cap between the ITRs. The rep ORF comprises four overlapping genes encoding Rep proteins required for the AAV life cycle. The cap ORF comprises overlapping genes encoding capsid proteins: VP1, VP2 and VP3, which interact together to form the viral capsid. VP1. VP2 and VP3 are translated from one mRNA transcript, which can be spliced in two different manners: either a longer or shorter intron can be excised resulting in the formation of two isoforms of mRNAs: a ~2.3 kb- and a ~2.6 kb-long mRNA isoform. The capsid forms a supramolecular assembly of approximately 60 individual capsid protein subunits into a non-enveloped, T-1 icosahedral lattice capable of protecting the AAV genome. The mature capsid is composed of VP1, VP2, and VP3 (molecular masses of approximately 87, 73, and 62 kDa respectively) in a ratio of about 1:1:10.

rAAV particles may comprise a nucleic acid vector (e.g., a recombinant genome), which may comprise at a minimum: (a) one or more heterologous nucleic acid regions comprising a sequence encoding a protein or polypeptide of interest (e.g., a split Cas9 or split nucleobase) or an RNA of interest (e.g., a gRNA), or one or more nucleic acid regions comprising a sequence encoding a Rep protein; and (b) one or more regions comprising inverted terminal repeat (ITR) sequences (e.g., wild-type ITR sequences or engineered ITR sequences) flanking the one or more nucleic acid regions (e.g., heterologous nucleic acid regions). In some embodiments, the nucleic acid vector is between 4 kb and 5 kb in size (e.g., 4.2 to 4.7 kb in size). In some embodiments, the nucleic acid vector further comprises a region encoding a Rep protein. In some embodiments, the nucleic acid vector is circular. In some embodiments, the nucleic acid vector is single-stranded. In some embodiments, the nucleic acid vector is double-stranded. In some embodiments, a double-stranded nucleic acid vector may be, for example, a self-complimentary vector that contains a region of the nucleic acid vector that is complementary to another region of the nucleic acid vector, initiating the formation of the double-strandedness of the nucleic acid vector.

Adenosine Deaminase

As used herein, the term "adenosine deaminase" or "adenosine deaminase domain" refers to a protein or enzyme that catalyzes a deamination reaction of an adenosine (or adenine). The terms are used interchangeably. In certain embodiments, the disclosure provides base editor fusion proteins comprising one or more adenosine deaminase domains. For instance, an adenosine deaminase domain may comprise a heterodimer of a first adenosine deaminase and a second deaminase domain, connected by a linker. Adenosine deaminases (e.g., engineered adenosine deaminases or evolved adenosine deaminases) provided herein may be enzymes that convert adenine (A) to inosine (I) in DNA or RNA. Such adenosine deaminase can lead to an A:T to G:C base pair conversion. In some embodiments, the deaminase is a variant of a naturally occurring deaminase from an organism. In some embodiments, the deaminase does not occur in nature. For example, in some embodiments, the deaminase is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

In some embodiments, the adenosine deaminase is derived from a bacterium, such as, *E. coli, S. aureus, S. typhi, S. putrefaciens, H. influenzae*, or *C. crescentus*. In some embodiments, the adenosine deaminase is a TadA deaminase. In some embodiments, the TadA deaminase is an *E. coli* TadA deaminase (ecTadA). In some embodiments, the TadA deaminase is a truncated *E. coli* TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 16, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 16, 17, 18, 19, or 20 C-terminal amino acid residues relative to the full length ecTadA. In some embodiments, the ecTadA deaminase does not comprise an N-terminal methionine. Reference is made to U.S. Patent Publication No. 2018/0073012, published Mar. 15, 2018, which is incorporated herein by reference.

Antisense Strand

In genetics, the "antisense" strand of a segment within double-stranded DNA is the template strand, and which is considered to run in the 3' to 5' orientation. By contrast, the "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

Base Editing

"Base editing" refers to genome editing technology that involves the conversion of a specific nucleic acid base into another at a targeted genomic locus (e.g., including in a mtDNA). In certain embodiments, this can be achieved without requiring double-stranded DNA breaks (DSB), or single stranded breaks (i.e., nicking). To date, other genome editing techniques, including CRISPR-based systems, begin with the introduction of a DSB at a locus of interest. Subsequently, cellular DNA repair enzymes mend the break, commonly resulting in random insertions or deletions (indels) of bases at the site of the DSB. However, when the introduction or correction of a point mutation at a target locus is desired rather than stochastic disruption of the entire gene, these genome editing techniques are unsuitable, as correction rates are low (e.g. typically 0.1% to 5%), with the major genome editing products being indels. In order to increase the efficiency of gene correction without simultaneously introducing random indels, the present inventors previously modified the CRISPR/Cas9 system to directly convert one DNA base into another without DSB formation. See. Komor, A. C., et aL, Programmable editing of a target base in genomic DNA without double-stranded DNA cleavage. Nature 533, 420-424 (2016), the entire contents of which is incorporated by reference herein.

Base Editor

The term "base editor (BE)" as used herein, refers to an agent comprising a polypeptide that is capable of making a modification to a base (e.g., A, T, C. G, or U) within a nucleic acid sequence (e.g., mtDNA) that converts one base to another (e.g., A to G, A to C, A to T, C to T. C to G. C to A, G to A, G to C, G to T. T to A, T to C, T to G). In some embodiments, the BE refers to those fusion proteins described herein which are capable of modifying bases directly in mtDNA. Such BEs can also be referred to herein as "mtDNA base editors" or "mtDNA BEs." 0 Such BEs can refer to those fusion proteins comprising a programmable DNA binding protein ("pDNAbp") (e.g., a mitoTALE, mitoZFP, or a CRISPR/Cas9) and a double-stranded DNA deaminase ("DddA") to precisely install nucleotide changes and/or correct pathogenic mutations in mtDNA, rather than destroying the mtDNA with double-strand breaks (DSBs). It should be noted that in some places DddA is referred to as DddE (e.g., FIG. 6 of the accompanying drawings). In these instances. DddE shall be interpreted to refer to DddA as a synonym.

In some embodiments, the base editors contemplated herein comprise a nuclease-inactive Cas9 (dCas9) fused to a deaminase which binds a nucleic acid in a guide RNA-programmed manner via the formation of an R-loop, but does not cleave the nucleic acid. For example, the dCas9 domain of the fusion protein may include a D10A and a H840A mutation (which renders Cas9 capable of cleaving only one strand of a nucleic acid duplex), as described in PCT/US2016/058344, which published as WO 2017/070632 on Apr. 27, 2017 and is incorporated herein by reference in its entirety. The DNA cleavage domain of *S. pyogenes* Cas9 includes two subdomains, the HNH nuclease subdomain and the RuvC1 subdomain. The HNH subdomain cleaves the strand complementary to the gRNA (the "targeted strand", or the strand in which editing or deamination occurs), whereas the RuvC1 subdomain cleaves the non-complementary strand containing the PAM sequence (the "non-edited strand"). The RuvC1 mutant D10A generates a nick in the targeted strand, while the HNH mutant H840A generates a nick on the non-edited strand (see Jinek et al., Science, 337:816-821(2012); Qi et al., Cell. 28; 152(5):1173-83 (2013)).

BEs that convert a C to T, in some embodiments, comprise a cytidine deaminase (e.g., a double-stranded DNA deaminase or DddA). A "cytidine deaminase" (including those DddAs disclosed herein) refers to an enzyme that catalyzes the chemical reaction "cytosine+$H_2O$→uracil+$NH_3$" or "5-methyl-cytosine+$H_2O$→thymine+$NH_3$." As it may be apparent from the reaction formula, such chemical reactions result in a C to U/T nucleobase change. In the context of a gene, such a nucleotide change, or mutation, may in turn lead to an amino acid change in the protein, which may affect the protein's function, e.g., loss-of-function or gain-of-function. In some embodiments, the C to T nucleobase editor comprises a dCas9 or nCas9 fused to a cytidine deaminase. In some embodiments, the cytidine deaminase domain is fused to the N-terminus of the dCas9 or nCas9.

In some embodiments, the nucleobase editor further comprises a domain that inhibits uracil glycosylase, and/or a nuclear localization signal.

Cas9 domains used in base editing have been described in the following references, the contents of which may be applied in the instant disclosure to modify and/or include in BEs described herein, which can target mtDNA, e.g., in Rees & Liu, Nat Rev Genet. 2018:19(12):770-788 and Koblan et al., Nat Biotechnol. 2018:36(9):843-846; as well as U.S. Patent Publication No. 2018/0073012, published Mar. 15, 2018, which issued as U.S. Pat. No. 10,113,163; on Oct. 30, 2018; U.S. Patent Publication No. 2017/0121693, published May 4. 2017, which issued as U.S. Pat. No. 10,167,457 on Jan. 1, 2019; International Publication No. WO 2017/070633, published Apr. 27, 2017; U.S. Patent Publication No. 2015/0166980, published Jun. 18, 2015; U.S. Pat. No. 9,840,699, issued Dec. 12, 2017; U.S. Pat. No. 10,077,453, issued Sep. 18, 2018; International Publication No. WO 2019/023680, published Jan. 31, 2019: International Publication No. WO 2018/0176009, published Sep. 27, 2018, International Application No PCT/US2019/033848, filed May 23, 2019, International Application No. PCT/US2019/47996, filed Aug. 23, 2019; International Application No. PCT/US2019/049793, filed Sep. 5. 2019: U.S. Provisional Application No. 62/835,490, filed Apr. 17, 2019; International Application No. PCT/US2019/61685, filed Nov. 15. 2019; International Application No. PCT/US2019/57956, filed Oct. 24, 2019; U.S. Provisional Application No. 62/858,958, filed Jun. 7, 2019: International Publication No. PCT/US2019/58678, filed Oct. 29, 2019, the contents of each of which are incorporated herein by reference in their entireties.

Exemplary adenine and cytosine base editors are also described in Rees & Liu, Base editing: precision chemistry on the genome and transcriptome of living cells, Nat. Rev. Genet. 2018:19(12):770-788: as well as U.S. Patent Publication No. 2018/0073012, published Mar. 15, 2018, which issued as U.S. Pat. No. 10,113,163, on Oct. 30, 2018; U.S. Patent Publication No. 2017/0121693, published May 4. 2017, which issued as U.S. Pat. No. 10,167,457 on Jan. 1, 2019: International Publication No. WO 2017/070633, published Apr. 27, 2017; U.S. Patent Publication No. 2015/0166980, published Jun. 18, 2015; U.S. Pat. No. 9,840,699, issued Dec. 12. 2017; and U.S. Pat. No. 10,077,453, issued Sep. 18, 2018, PCT Application PCT/US2017/045381, filed Aug. 3, 2017, which published as WO 2018/027078, and PCT Application No. PCT/US2019/033848, which published as WO 2019/226953, each of which is herein incorporated by reference. Any of the deaminase components of these adenine or cytidine BEs could be modified using a method of directed evolution (e.g., PACE or PANCE) to obtain a deaminase which may use double-stranded DNA as a substrate, and thus, which could be used in the BEs described herein which are intended for use in conducting base editing directly on mtDNA, i.e., on a double-stranded DNA target.

Cas9

The term "Cas9" or "Cas9 nuclease" refers to an RNA-guided nuclease comprising a Cas9 domain, or a fragment thereof (e.g., a protein comprising an active or inactive DNA cleavage domain of Cas9, and/or the gRNA binding domain of Cas9). A "Cas9 domain" as used herein, is a protein fragment comprising an active or inactive cleavage domain of Cas9 and/or the gRNA binding domain of Cas9. A "Cas9 protein" is a full length Cas9 protein. A Cas9 nuclease is also referred to sometimes as a casn1 nuclease or a CRISPR (Clustered Regularly Interspaced Short Palindromic Repeat)-associated nuclease. CRISPR is an adaptive immune system that provides protection against mobile genetic elements (viruses, transposable elements, and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 domain. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature. DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821 (2012), the entire contents of which are hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S, thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737; the entire contents of which are incorporated herein by reference. In some embodiments, a Cas9 nuclease comprises one or more mutations that partially impair or inactivate the DNA cleavage domain.

A nuclease-inactivated Cas9 domain may interchangeably be referred to as a "dCas9" protein (for nuclease-"dead" Cas9). Methods for generating a Cas9 domain (or a fragment thereof) having an inactive DNA cleavage domain are known (see, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012): Qi et al., *Cell.* 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, at least about 99.8% identical, or at least about 99.9% identical to wild type Cas9 (e.g., SpCas9 of SEQ ID NO: 28). In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9 (e.g., SpCas9 of SEQ ID NO: 28). In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9 (e.g., SpCas9 of SEQ ID NO: 28). In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SpCas9 of SEQ ID NO: 28).

As used herein, the term "nCas9" or "Cas9 nickase" refers to a Cas9 or a variant thereof, which cleaves or nicks only one of the strands of a target cut site thereby introducing a nick in a double strand DNA molecule rather than creating a double strand break. This can be achieved by introducing appropriate mutations in a wild-type Cas9 which inactivates one of the two endonuclease activities of the Cas9. Any suitable mutation which inactivates one Cas9 endonuclease activity but leaves the other intact is contemplated, such as one of D10A or H840A mutations in the wild-type *S. pyogenes* Cas9 amino acid sequence, or a D10A mutation in the wild-type *S. aureus* Cas9 amino acid sequence, may be used to form the nCas9.

cDNA

The term "cDNA" refers to a strand of DNA copied from an RNA template. cDNA is complementary to the RNA template.

Circular Permutant

As used herein, the term "circular permutant" refers to a protein or polypeptide comprising a circular permutation, which is change in the protein's structural configuration involving a change in order of amino acids appearing in the protein's amino acid sequence. In other words, circular permutants are proteins that have altered N- and C-termini as compared to a wild-type counterpart, e.g., the wild-type C-terminal half of a protein becomes the new N-terminal half. Circular permutation (or CP) is essentially the topological rearrangement of a protein's primary sequence, connecting its N- and C-terminus, often with a peptide linker, while concurrently splitting its sequence at a different position to create new, adjacent N- and C-termini. The result is a protein structure with different connectivity, but which often can have the same overall similar three-dimensional (3D) shape, and possibly include improved or altered characteristics, including, reduced proteolytic susceptibility, improved catalytic activity, altered substrate or ligand binding, and/or improved thermostability. Circular permutant proteins can occur in nature (e.g., concanavalin A and lectin). In addition, circular permutation can occur as a result of posttranslational modifications or may be engineered using recombinant techniques. Any of the polypeptides contemplated for use in the mtDNA base editors disclosed herein may be converted to circular permutant variants, including any pDNAbp (e.g., Cas9, mitoTALE, or mitoZFP) and any double-stranded DNA deaminase (e.g., DddA).

Circularly Permuted naoDNAbp

In the case of circular permutant Cas9s or other napDNAbps that could be used with the mtDNA base editors contemplated herein, the term "circularly permuted napDNAbp" refers to any napDNAbp protein, or variant thereof (e.g., SpCas9), that occurs as or engineered as a circular permutant, whereby its N- and C-termini have been topically rearranged. Such circularly permuted proteins ("CP-napDNAbp", such as "CP-Cas9" in the case of Cas9), or variants thereof, retain the ability to bind DNA when complexed with a guide RNA (gRNA). See, Oakes et al., "Protein Engineering of Cas9 for enhanced function." *Methods Enzymol,* 2014, 546: 491-511 and Oakes et al., "CRISPR-Cas9 Circular Permutants as Programmable Scaffolds for Genome Modification," *Cell*. Jan. 10, 2019, 176: 254-267, each of are incorporated herein by reference. The instant disclosure contemplates any previously known CP-Cas9 or use a new CP-Cas9 so long as the resulting circularly permuted protein retains the ability to bind DNA when complexed with a guide RNA (gRNA). Such CP variants of Cas9 can be used with the mtDNA base editors described herein.

Cytidine Deaminase

As used herein, a "cytidine deaminase" encoded by the CDA gene is an enzyme that catalyzes the removal of an amine group from cytidine (i.e., the base cytosine when attached to a ribose ring) to uridine (C to U) and deoxycytidine to deoxyuridine (C to U). A non-limiting example of a cytidine deaminase is APOBEC1 ("apolipoprotein B mRNA editing enzyme, catalytic polypeptide 1"). Another example is AID ("activation-induced cytidine deaminase"). Under standard Watson-Crick hydrogen bond pairing, a cytosine base hydrogen bonds to a guanine base. When cytidine is converted to uridine (or deoxycytidine is converted to deoxyuridine), the uridine (or the uracil base of uridine) undergoes hydrogen bond pairing with the base adenine. Thus, a conversion of "C" to uridine ("U") by cytidine deaminase will cause the insertion of "A" instead of a "G" during cellular repair and/or replication processes. Since the adenine "A" pairs with thymine "T", the cytidine deaminase in coordination with DNA replication causes the conversion of an C•G pairing to a T•A pairing in the double-stranded DNA molecule.

CRISPR

CRISPR is a family of DNA sequences (i.e., CRISPR clusters) in bacteria and archaea that represent snippets of prior infections by a virus that have invaded the prokaryote. The snippets of DNA are used by the prokaryotic cell to detect and destroy DNA from subsequent attacks by similar viruses and effectively compose, along with an array of CRISPR-associated proteins (including Cas9 and homologs thereof) and CRISPR-associated RNA, a prokaryotic immune defense system. In nature, CRISPR clusters are transcribed and processed into CRISPR RNA (crRNA). In certain types of CRISPR systems (e.g., type II CRISPR systems), correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species—the guide RNA. See, e.g., Jinek M., Chylinski K., Fonfara I., Hauer M., Doudna J.A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. CRISPR biology, as well as Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S.W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M.R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J.A., Charpentier E. Science 337:816-821(2012), the entire contents of each of which are incorporated herein by reference). Cas9 orthologs have been described in various species, including, but not limited to, *S. pyogenes* and *S, thermophilus*. Additional suitable Cas9 nucleases and sequences will be apparent to those of skill in the art based on this disclosure, and such Cas9 nucleases and sequences include Cas9 sequences from the organisms and loci disclosed in Chylinski. Rhun, and Charpentier, "The tracrRNA and Cas9 families of type II CRISPR-Cas immunity systems" (2013) RNA Biology 10:5. 726-737; the entire contents of which are incorporated herein by reference.

Deaminase

The term "deaminase" or "deaminase domain" refers to a protein or enzyme that catalyzes a deamination reaction. In some embodiments, the deaminase is an adenosine (or adenine) deaminase, which catalyzes the hydrolytic deamination of adenine or adenosine. In some embodiments, the adenosine deaminase catalyzes the hydrolytic deamination of adenine or adenosine in deoxyribonucleic acid (DNA) to inosine. In other embodiments, the deaminase is a cytidine (or cytosine) deaminase, which catalyzes the hydrolytic deamination of cytidine or cytosine. In preferred aspects, the deaminase is a double-stranded DNA deaminase, or is modified, evolved, or otherwise altered to be able to utilize double-strand DNA as a substrate for deamination.

The deaminase embraces the DddA domains described herein, and defined below. The DddA is a type of deaminase, but where the activity of the deaminase is against double-stranded DNA, rather than single-stranded DNA, which is the case for deaminases prior to the present disclosure.

The deaminases provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

DNA Editing Efficiency

The term "DNA editing efficiency," as used herein, refers to the number or proportion of intended base pairs that are edited. For example, if a base editor edits 10% of the base pairs that it is intended to target (e.g., within a cell or within a population of cells), then the base editor can be described as being 10% efficient. Some aspects of editing efficiency embrace the modification (e.g. deamination) of a specific nucleotide within DNA, without generating a large number or percentage of insertions or deletions (i.e., indels). It is generally accepted that editing while generating less than 5% indels (as measured over total target nucleotide substrates) is high editing efficiency. The generation of more than 20% indels is generally accepted as poor or low editing efficiency. Indel formation may be measured by techniques known in the art, including high-throughput screening of sequencing reads.

Downstream

As used herein, the terms "upstream" and "downstream" are relative terms that define the linear position of at least two elements located in a nucleic acid molecule (whether single or double-stranded) that is orientated in a 5'-to-3' direction. In particular, a first element is upstream of a second element in a nucleic acid molecule where the first element is positioned somewhere that is 5' to the second element. For example, a SNP is upstream of a Cas9-induced nick site if the SNP is on the 5' side of the nick site. Conversely, a first element is downstream of a second element in a nucleic acid molecule where the first element is positioned somewhere that is 3' to the second element. For example, a SNP is downstream of a Cas9-induced nick site if the SNP is on the 3' side of the nick site. The nucleic acid molecule can be a DNA (double or single stranded). RNA (double or single stranded), or a hybrid of DNA and RNA. The analysis is the same for single strand nucleic acid molecule and a double strand molecule since the terms upstream and downstream are in reference to only a single strand of a nucleic acid molecule, except that one needs to select which strand of the double stranded molecule is being considered. Often, the strand of a double stranded DNA which can be used to determine the positional relativity of at least two elements is the "sense" or "coding" strand. In genetics, a "sense" strand is the segment within double-stranded DNA that runs from 5' to 3', and which is complementary to the antisense strand of DNA, or template strand, which runs from 3' to 5'. Thus, as an example, a SNP nucleobase is "downstream" of a promoter sequence in a genomic DNA (which is double-stranded) if the SNP nucleobase is on the 3' side of the promoter on the sense or coding strand.

In another example, the mtDNA BEs contemplated herein can comprise a pair of fusion proteins wherein a first fusion protein binds upstream of a target nucleobase pair target of deamination, and a second fusion protein binds just downstream of the target nucleobase pair that is being targeted for deamination. The pair of fusion proteins each comprise a pDNAbp (e.g., a Cas9 domain, a mitoTALE, or a mitoZFP) which bind to a target site on either side of the targeted nucleobase pair. Each of the pDNAbps of each fusion protein are each fused to a DddA half portion (e.g., an N-terminal half and a C-terminal half of a DddA which is divided into two inactive fragments at a split site), which become co-localized at the target nucleobase pair upon binding of the pDNAbp domains at their respective upstream and downstream sites.

DddA

The term "double-stranded DNA deaminase domain" or "DddA" (or equivalently. DddE) refers to a protein which catalyzes a deamination of a target nucleotide (e.g., C, A, G, C) in a double-stranded DNA molecule. Reference to DddA and double-stranded DNA deaminase are equivalent. In one embodiment, the DddA deaminates a cytidine. Deamination of cytidine, results in a uracil (or deoxyuracil in the case of deoxycytidine), and through replication and/or repair processes, converts the original C:G base pair to a T:A base pair. This change can also be referred to as a "C-to-T" edit because the C of the C:G pair is converted to a T of T:A pair. DddA, when expressed naturally, can be toxic to biological systems. While the mechanism of action is not clearly documented, one rationale for the observed toxicity is DddA's activity may cause indiscriminant deamination of cytidine in vivo on double-stranded target DNA (e.g., the cellular genome). Such indiscriminant deaminations may provoke celluar repair responses, including, but not limited to, degradation of genomic DNA.

Effective Amount

The term "effective amount," as used herein, refers to an amount of a biologically active agent that is sufficient to elicit a desired biological response. For example, in some embodiments, an effective amount of any of the fusion proteins as described herein, or compositions thereof, may refer to the amount of the fusion proteins sufficient to edit a target nucleotide sequence (e.g., mtDNA). In some embodiments, an effective amount of any of the fusion proteins as described herein, or compositions thereof (e.g., a fusion protein comprising a first mitoTALE or another pDNAbp and a first portion of a DddA, a second fusion protein comprising a second mitoTALE or another pDNAbp and a second portion of a DddA) that is sufficient to induce editing of a target nucleotide, which is proximal to a target nucleic acid sequence specifically bound and edited by the fusion protein (e.g., by the first or second mitoTALE). As will be appreciated by the skilled artisan, the effective amount of an agent (e.g., a fusion protein, a second fusion protein), may vary depending on various factors as, for example, on the desired biological response on the specific allele, genome, or target site to be edited, on the cell or tissue being targeted, and on the agent being used.

Fusion Protein

The term "fusion protein" as used herein refers to a hybrid polypeptide which comprises protein domains from at least two different proteins (e.g., a first mitoTALE, a first portion of a DddA, a second mitoTALE, a second portion of a DddA). One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding site (e.g., a first or second mitoTALE) and a catalytic domain of a nucleic-acid editing protein (e.g., a first or second portion of a DddA). Another example includes a mitoTALE to a DddA or portion thereof. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A laboratory Manual* ($4^{th}$ ed., Cold Spring Harbor Laboratory Press, Cold Spring Harbor, N.Y. (2012)), the entire contents of which are incorporated herein by reference.

Guide Nucleic Acid

In embodiments involving mtDNA base editors that comprise Cas9 domains as the pDNAbp component, the Cas9 domain requires a guide RNA (or more generically, a guide nucleic acid) to program the binding of the Cas9 to a target site. The term "guide nucleic acid" or "napDNAbp-programming nucleic acid molecule" or equivalently "guide sequence" refers the one or more nucleic acid molecules which associate with and direct or otherwise program a napDNAbp protein to localize to a specific target nucleotide sequence (e.g., a gene locus of a genome) that is complementary to the one or more nucleic acid molecules (or a portion or region thereof) associated with the protein, thereby causing the napDNAbp protein to bind to the nucleotide sequence at the specific target site. A non-limiting example is a guide RNA of a Cas protein of a CRISPR-Cas genome editing system.

Guide RNA is a particular type of guide nucleic acid which is mostly commonly associated with a Cas protein of a CRISPR-Cas9 and which associates with Cas9, directing the Cas9 protein to a specific sequence in a DNA molecule that includes complementarity to protospace sequence of the guide RNA. As used herein, a "guide RNA" refers to a synthetic fusion of the endogenous bacterial crRNA and tracrRNA that provides both targeting specificity and scaffolding and/or binding ability for Cas9 nuclease to a target DNA. This synthetic fusion does not exist in nature and is also commonly referred to as an sgRNA. However, this term also embraces the equivalent guide nucleic acid molecules that associate with Cas9 equivalents, homologs, orthologs, or paralogs, whether naturally occurring or non-naturally occurring (e.g., engineered or recombinant), and which otherwise program the Cas9 equivalent to localize to a specific target nucleotide sequence. The Cas9 equivalents may include other napDNAbp from any type of CRISPR system (e.g., type II, V, VI), including Cpf1 (a type-V CRISPR-Cas systems), C2c1 (a type V CRISPR-Cas system). C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference. Exemplary sequences are and structures of guide RNAs are provided herein. In addition, methods for designing appropriate guide RNA sequences are provided herein.

Guide RNA ("eRNA")

In embodiments involving pDNAbp/DddA base editors that comprise Cas9 domains as the pDNAbp component, the Cas9 domain requires a guide RNA (or more generically, a guide nucleic acid) to program the binding of the Cas9 to a target site. As used herein, the term "guide RNA" is a particular type of guide nucleic acid which is mostly commonly associated with a Cas protein of a CRISPR-Cas9 and which associates with Cas9, directing the Cas9 protein to a specific sequence in a DNA molecule that includes complementarity to protospace sequence of the guide RNA. However, this term also embraces the equivalent guide nucleic acid molecules that associate with Cas9 equivalents, homologs, orthologs, or paralogs, whether naturally occurring or non-naturally occurring (e.g., engineered or recombinant), and which otherwise program the Cas9 equivalent to localize to a specific target nucleotide sequence. The Cas9 equivalents may include other napDNAbp from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference. Exemplary sequences are and structures of guide RNAs are provided herein.

Guide RNAs may comprise various structural elements that include, but are not limited to (a) a spacer sequence—the sequence in the guide RNA (having ~20 nts in length) which binds to a complementary strand of the target DNA (and has the same sequence as the protospacer of the DNA) and (b) a gRNA core (or gRNA scaffold or backbone sequence)—refers to the sequence within the gRNA that is responsible for Cas9 binding, it does not include the ~20 bp spacer sequence that is used to guide Cas9 to target DNA.

Guide RNA Target Sequence

As used herein, the "guide RNA target sequence" refers to the ~20 nucleotides that are complementary to the protospacer sequence in the PAM strand. The target sequence is the sequence that anneals to or is targeted by the spacer sequence of the guide RNA. The spacer sequence of the guide RNA and the protospacer have the same sequence (except the spacer sequence is RNA and the protospacer is DNA).

Guide RNA Scaffold Sequence

As used herein, the "guide RNA scaffold sequence" refers to the sequence within the gRNA that is responsible for Cas9 binding, it does not include the 20 bp spacer/targeting sequence that is used to guide Cas9 to target DNA.

Host Cell

The term "host cell," as used herein, refers to a cell that can host, replicate, and transfer a phage vector useful for a continuous evolution process as provided herein. In embodiments where the vector is a viral vector, a suitable host cell is a cell that may be infected by the viral vector, can replicate it, and can package it into viral particles that can infect fresh host cells. A cell can host a viral vector if it supports expression of genes of viral vector, replication of the viral genome, and/or the generation of viral particles. One criterion to determine whether a cell is a suitable host cell for a given viral vector is to determine whether the cell can support the viral life cycle of a wild-type viral genome that the viral vector is derived from. For example, if the viral vector is a modified M13 phage genome, as provided in some embodiments described herein, then a suitable host cell would be any cell that can support the wild-type M13 phage life cycle. Suitable host cells for viral vectors useful in continuous evolution processes are well known to those of skill in the art, and the disclosure is not limited in this respect. In some embodiments, the viral vector is a phage and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, and XL1-Blue MRF'. These strain names are art recognized and the genotype of these strains has been well characterized. It should be understood that the above strains are exemplary only and that the invention is not limited in this respect. The term "fresh," as used herein interchangeably with the terms "non-infected" or "uninfected" in the context of host cells, refers to a host cell that has not been infected by a viral vector comprising a gene of interest as used in a continuous evolution process provided herein. A fresh host cell can, however, have been infected by a viral vector unrelated to the vector to be evolved or by a vector of the same or a similar type but not carrying the gene of interest.

In some embodiments, the host cell is a prokaryotic cell, for example, a bacterial cell. In some embodiments, the host cell is an *E. coli* cell. In some embodiments, the host cell is a eukaryotic cell, for example, a yeast cell, an insect cell, or a mammalian cell. The type of host cell, will, of course, depend on the viral vector employed, and suitable host cell/viral vector combinations will be readily apparent to those of skill in the art.

Inteins and Split-Inteins

In some embodiments, the mtDNA base editors or the polypeptides that comprise the mtDNA base editors (e.g., the pDNAbps and DddA) may be engineered to include intein and/or split-intein amino acid sequences.

As used herein, the term "intein" refers to auto-processing polypeptide domains found in organisms from all domains of life. An intein (intervening protein) carries out a unique auto-processing event known as protein splicing in which it excises itself out from a larger precursor polypeptide through the cleavage of two peptide bonds and, in the process, ligates the flanking extein (external protein) sequences through the formation of a new peptide bond. This rearrangement occurs post-translationally (or possibly co-translationally), as intein genes are found embedded in frame within other protein-coding genes. Furthermore, intein-mediated protein splicing is spontaneous; it requires no external factor or energy source, only the folding of the intein domain. This process is also known as cis-protein splicing, as opposed to the natural process of trans-protein splicing with "split inteins."

Split inteins are a sub-category of inteins. Unlike the more common contiguous inteins, split inteins are transcribed and translated as two separate polypeptides, the N-intein and C-intein, each fused to one extein. Upon translation, the intein fragments spontaneously and non-covalently assemble into the canonical intein structure to carry out protein splicing in trans.

Inteins and split inteins are the protein equivalent of the self-splicing RNA introns (see Perler et al., Nucleic Acids Res. 22:1125-1127 (1994)), which catalyze their own excision from a precursor protein with the concomitant fusion of the flanking protein sequences, known as exteins (reviewed in Perler et al., Curr. Opin. Chem. Biol. 1:292-299 (1997); Perler, F. B. Cell 92(1):1-4 (1998); Xu et al., EMBO J. 15(19):5146-5153 (1996)).

As used herein, the term "protein splicing" refers to a process in which an interior region of a precursor protein (an intein) is excised and the flanking regions of the protein (exteins) are ligated to form the mature protein. This natural process has been observed in numerous proteins from both prokaryotes and eukaryotes (Perler, F. B., Xu, M. Q., Paulus, H. Current Opinion in Chemical Biology 1997, 1, 292-299: Perler. F. B. Nucleic Acids Research 1999, 27, 346-347). The intein unit contains the necessary components needed to catalyze protein splicing and often contains an endonuclease domain that participates in intein mobility (Perler. F. B., Davis, E. O., Dean, G. E., Gimble, F. S., Jack, W. E., Neff, N., Noren, C. J., Thomer, J., Belfort, M. Nucleic Acids Research 1994. 22, 1127-1127). The resulting proteins are linked, however, not expressed as separate proteins. Protein splicing may also be conducted in trans with split inteins expressed on separate polypeptides spontaneously combine to form a single intein which then undergoes the protein splicing process to join to separate proteins.

The elucidation of the mechanism of protein splicing has led to a number of intein-based applications (Comb, et al., U.S. Pat. No. 5,496,714; Comb, et al., U.S. Pat. No. 5,834, 247; Camarero and Muir, J. Amer. Chem. Soc., 121:5597-5598 (1999); Chong, et al., Gene, 192:271-281 (1997). Chong, et al., Nucleic Acids Res., 26:5109-5115 (1998); Chong, et al., J. Biol. Chem., 273:10567-10577 (1998); Cotton, et al. J. Am. Chem. Soc., 121:1100-1101 (1999); Evans, et al., J. Biol. Chem., 274:18359-18363 (1999); Evans, et al., J. Biol. Chem., 274:3923-3926 (1999); Evans, et al., Protein Sci., 7:2256-2264 (1998): Evans, et al., J. Biol. Chem., 275:9091-9094 (2000); Iwai and Pluckthun, FEBS Lett. 459:166-172 (1999); Mathys, et al., Gene, 231:1-13 (1999); Mills, et al., Proc. Natl. Acad. Sci. USA 95:3543-3548 (1998); Muir, et al., Proc. Natl. Acad. Sci. USA 95:6705-6710 (1998); Otomo, et al., Biochemistry 38:16040-16044 (1999); Otomo, et al., J. Biolmol. NMR 14:105-114 (1999); Scott, et al., Proc. Natl. Acad. Sci. USA 96:13638-13643 (1999); Severinov and Muir, J. Biol. Chem., 273:16205-16209 (1998): Shingledecker, et al., Gene, 207:187-195 (1998): Southworth, et al., EMBO J. 17:918-926 (1998); Southworth, et al., Biotechniques. 27:110-120 (1999); Wood, et al., Nat. Biotechnol., 17:889-892 (1999); Wu, et al., Proc. Natl. Acad. Sci. USA 95:9226-9231 (1998a); Wu, et al., Biochim Biophys Acta 1387:422-432 (1998b); Xu, et al., Proc. Natl. Acad. Sci. USA 96:388-393 (1999); Yamazaki, et al., J. Am. Chem. Soc., 120:5591-5592 (1998)). Each reference is incorporated herein by reference.

Lentiviral Vectors

Lentiviral vectors are derived from human immunodeficiency virus-1 (HIV-1). The lentiviral genome consists of single-stranded RNA that is reverse-transcribed into DNA and then integrated into the host cell genome. Lentiviruses can infect both dividing and non-dividing cells, making them attractive tools for gene therapy.

The lentiviral genome is around 9 kb in length and contains three major structural genes: gag, pol, and env. The gag gene is translated into three viral core proteins: 1) matrix (MA) proteins, which are necessary for virion assembly and infection of non-dividing cells; 2) capsid (CA) proteins, which form the hydrophobic core of the virion; and 3) nucleocapsid (NC) proteins, which protect the viral genome by coating and associating tightly with the RNA. The pol gene encodes for the viral protease, reverse transcriptase, and integrase enzymes which are essential for viral replication. The env gene encodes for the viral surface glycoproteins, which are essential for virus entry into the host cell by enabling binding to cellular receptors and fusion with cellular membranes. In some embodiments, the viral glycoprotein is derived from vesicular stomatitis virus (VSV-G). The viral genome also contains regulatory genes, including tat and rev. Tat encodes transactivators critical for activating viral transcription, while rev encodes a protein that regulates the splicing and export of viral transcripts. Tat and rev are the first proteins synthesized following viral integration and are required to accelerate production of viral mRNAs.

To improve the safety of lentivirus, the components necessary for viral production are split across multiple vectors. In some embodiments, the disclosure relates to delivery of a heterologous gene (e.g., transgene) via a recombinant lentiviral transfer vector encoding one or more transgenes of interest flanked by long terminal repeat (LTR) sequences. These LTRs are identical nucleotide sequences that are repeated hundreds or thousands of times and facilitate the integration of the transfer plasmid sequences into the host cell genome. Methods of the current disclosure also describe one or more accessory plasmids. These accessory plasmids may include one or more lentiviral packaging plasmids, which encode the pol and rev genes that are necessary for the replication, splicing, and export of viral particles. The accessory plasmids may also include a lentiviral envelope plasmid, which encodes the genes necessary for producing the viral glycoproteins which will allow the viral particle to fuse with the host cell.

Ligand-Dependent Intein

In some embodiments, the mtDNA base editors or the polypeptides that comprise the mtDNA base editors (e.g., the pDNAbps and DddA) may be engineered to include ligand-dependent inteins.

The term "ligand-dependent intein," as used herein refers to an intein that comprises a ligand-binding domain. Typically, the ligand-binding domain is inserted into the amino acid sequence of the intein, resulting in a structure intein (N)—ligand-binding domain—intein (C). Typically, ligand-dependent inteins exhibit no or only minimal protein splicing activity in the absence of an appropriate ligand, and a marked increase of protein splicing activity in the presence of the ligand. In some embodiments, the ligand-dependent intein does not exhibit observable splicing activity in the absence of ligand but does exhibit splicing activity in the presence of the ligand. In some embodiments, the ligand-dependent intein exhibits an observable protein splicing activity in the absence of the ligand, and a protein splicing activity in the presence of an appropriate ligand that is at least 5 times, at least 10 times, at least 50 times, at least 100 times, at least 150 times, at least 200 times, at least 250 times, at least 500 times, at least 1000 times, at least 1500 times, at least 2000 times, at least 2500 times, at least 5000 times, at least 10000 times, at least 20000 times, at least 25000 times, at least 50000 times, at least 100000 times, at least 500000 times, or at least 1000000 times greater than the activity observed in the absence of the ligand. In some embodiments, the increase in activity is dose dependent over at least 1 order of magnitude, at least 2 orders of magnitude, at least 3 orders of magnitude, at least 4 orders of magnitude, or at least 5 orders of magnitude, allowing for fine-tuning of intein activity by adjusting the concentration of the ligand. Suitable ligand-dependent inteins are known in the art, and in include those provided below and those described in published U.S. Patent Application U.S. 2014/0065711 A1; Mootz et al., "Protein splicing triggered by a small molecule." *J. Am. Chem. Soc.* 2002; 124, 9044-9045; Mootz et al., "Conditional protein splicing: a new tool to control protein structure and function in vitro and in vivo." *J. Am. Chem. Soc.* 2003; 125, 10561-10569; Buskirk et al., *Proc. Natl. Acad. Sci. USA.* 2004; 101. 10505-10510); Skretas & Wood, "Regulation of protein activity with small-molecule-controlled inteins." *Protein Sci.* 2005: 14, 523-532; Schwartz, et al., "Post-translational enzyme activation in an animal via optimized conditional protein splicing." *Nat. Chem. Biol.* 2007; 3, 50-54; Peck et al.,, *Chem. Biol.* 2011; 18 (5). 619-630; the entire contents of each are hereby incorporated by reference. Exemplary sequences are as follows:

| NAME | SEQUENCE OF LIGAND-DEPENDENT INTEIN | SEQ ID NO: |
|---|---|---|
| 2-4 INTEIN: | CLAEGTRIFDPVTGTTHRIEDVVDGRKPIHVVAAAKDGTLLARPVVSWFDQGTRDVI GLRIAGGAIVWATPDHKVLTEYGWRAAGELRKGDRVAGPGGSGNSLALSLTADQMVS ALLDAEPPILYSEYDPTSPFSEASMMGLLINLADRELVHMINWAKRVPGFVDLTLHD QAHLLECAWLEILMIGLVWRSMEHPGKLLFAPNLLLDRNQGKCVEGMVEIFDMLLAT SSRFRMMNLQGEEFVCLKSIILLNSGVYTFLSSTLKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEELRYSVIREVLPTRRARTFDLEVEE LHTLVAEGVVVHNC | 17 |
| 3-2 INTEIN | CLAEGTRIFDPVTGTTHRIEDVVDGRKPIHVVAVAKDGTLLARPVVSWFDQGTRDVI GLRIAGGAIVWATPDHKVLTEYGWRAAGELRKGDRVAGPGGSGNSLALSLTADQMVS ALLDAEPPILYSEYDPTSPFSEASMMGLLTNLADRELVHMINWAKRVPGFVDLTLHD QAHLLECAWLEILMIGLVWRSMEHPGKLLFAPNLLLDRNQGKCVEGMVEIFDMLLAT SSRFRMMNLQGEEFVCLKSIILLNSGVYTFLSSTLKSLEEKDHIHRALDKITDTLIH LMAKAGLTLQQQHQRLAQLLLILSHIRHMSNKGMEHLYSMKYTNVVPLYDLLLEMLD AHRLHAGGSGASRVQAFADALDDKFLHDMLAEELRYSVIREVLPTRRARTFDLEVEE LHTLVAEGVVVHNC | 18 |
| 30R3-1 INTEIN | CLAEGTRIFDPVIGTTHRIEDVVDGRKPIHVVAAAKDGTLLARPVVSWFDQGTRDVI GLRIAGGATVWATPDHKVLTEYGWRAAGELRKGDRVAGPGGSGNSLALSLTADQMVS ALLDAEPPIPYSEYDPTSPFSEASMMGLLINLADRELVHMINWAKRVPGFVDLTLHD QAHLLECAWLEILMIGLVWRSMEHPGKLLFAPNLLLDRNQGKCVEGMVEIFDMLLAT SSRFRMMNLQGEEFVCLKSIILLNSGVYTFLSSILKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEGLRYSVIREVLPTRRARTFDLEVEE LHTLVAEGVVVHNC | 19 |

-continued

| NAME | SEQUENCE OF LIGAND-DEPENDENT INTEIN | SEQ ID NO: |
|---|---|---|
| 30R3-2 INTEIN | CLAEGTRIFDPVTGTTHRIEDVVDGRKPIHVVAAAKDGTLLARPVVSWFDQGTRDVI GLRIAGGATVWATPDHKVLTEYGWRAAGELRKGDRVAGPGGSGNSLALSLTADQMVS ALLDAEPPILYSEYDPTSPFSEASMMGLLTNLADRELVHMINWAKRVPGFVDLTLHD QAHLLECAWLEILMIGLVWRSMEHPGKLLFAPNLLLDRNQGKCVEGMVEIFDMLLAT SSRFRMMNLQGEEFVCLKSIILLNSGVYTFLSSTLKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEELRYSVIREVLPTRRARTFDLEVEE LHTLVAEGVVVHNC | 20 |
| 30R3-3 INTEIN | CLAEGTRIFDPVTGTTHRIEDVVDGRKPIHVVAAAKDGTLLARPVVSWFDQGTRDVI GLRIAGGATVWATPDHKVLTEYGWRAAGELRKGDRVAGPGGSGNSLALSLTADQMVS ALLDAEPPIPYSEYDPTSPFSEASMMGLLTNLADRELVHMINWAKRVPGFVDLTLHD QAHLLECAWLEILMIGLVWRSMEHPGKLLFAPNLLLDRNQGKCVEGMVEIFDMLLAT SSRFRMMNLQGEEFVCLKSIILLNSGVYTFLSSTLKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEELRYSVIREVLPTRRARTFDLEVEE LHTLVAEGVVVHNC | 21 |
| 37R3-1 INTEIN | CLAEGTRIFDPVTGTTHRIEDVVDGRKPIHVVAAAKDGTLLARPVVSWFDQGTRDVI GLRIAGGATVWATPDHKVLTEYGWRAAGELRKGDRVAGPGGSGNSLALSLTADQMVS ALLDAEPPILYSEYNPTSPFSEASMMGLLINLADRELVHMINWAKRVPGFVDLTLHD QAHLLERAWLEILMIGLVWRSMEHPGKLLFAPNLLLDRNQGKCVEGMVEIFDMLLAT SSRFRMMNLQGEEFVCLKSIILLNSGVYTFLSSTLKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEGLRYSVIREVLPTRRARTFDLEVEE LHTLVAEGVVVHNC | 22 |
| 37R3-2 INTEIN | CLAEGTRIFDPVTGTTHRIEDVVDGRKPIHVVAAAKDGILLARPVVSWFDQGTRDVI GLRIAGGAIVWATPDHKVLTEYGWRAAGELRKGDRVAGPGGSGNSLALSLTADQMVS ALLDAEPPILYSEYDPTSPFSEASMMGLLINLADRELVHMINWAKRVPGFVDLILHD QAHLLERAWLEILMIGLVWRSMEHPGKLLFAPNLLLDRNQGKCVEGMVEIFDMLLAT SSRFRMMNLQGEEFVCLKSIILLNSGVYTFLSSILKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEGLRYSVIREVLPTRRARTFDLEVEE LHTLVAEGVVVHNC | 23 |
| 37R3-3 INTEIN | CLAEGTRIFDPVTGTTHRIEDVVDGRKPIHVVAVAKDGTLLARPVVSWFDQGTRDVI GLRIAGGATVWATPDHKVLTEYGWRAAGELRKGDRVAGPGGSGNSLALSLTADQMVS ALLDAEPPILYSEYDPTSPFSEASMMGLLTNLADRELVHMINWAKRVPGFVDLTLHD QAHLLERAWLEILMIGLVWRSMEHPGKLLFAPNLLLDRNQGKCVEGMVEIFDMLLAT SSRFRMMNLQGEEFVCLKSIILLNSGVYTFLSSILKSLEEKDHIHRALDKITDTLIH LMAKAGLTLQQQHQRLAQLLLILSHIRHMSNKGMEHLYSMKYKNVVPLYDLLLEMLD AHRLHAGGSGASRVQAFADALDDKFLHDMLAEELRYSVIREVLPTRRARTFDLEVEE LHTLVAEGVVVHNC | 24 |

Linker

In various embodiments, the herein disclosed fusion proteins (e.g., the mtDNA base editors) or the polypeptides that comprise the mtDNA base editors (e.g., the pDNAbps and DddA) may be engineered to include one or more linker sequences that join two or more polypeptides (e.g., a pDNAbp and a DddA halt) to one another.

The term "linker," as used herein, refers to a molecule linking two other molecules or moieties. The linker can be an amino acid sequence in the case of a linker joining two fusion proteins. For example, a first or second mitoTALE can be fused to a first or second portion of a DddA, by an amino acid linker sequence. The linker can also be a nucleotide sequence in the case of joining two nucleotide sequences together. In other embodiments, the linker is an organic molecule, group, polymer, or chemical moiety. In some embodiments, the linker is 1-100 amino acids in length, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length, Longer linkers are also contemplated.

mitoTALE

In various embodiments, the mtDNA base editors embrace fusion proteins comprising a DddA (or inactive fragment thereof) and a mitoTALE domain. As used herein, a "mitoTALE" protein or domain refers to a modified TALE protein that can be designed to localize to the mitochondria. In one embodiment, a mitoTALE comprises a TALE domain fused to a mitochondrial targeting sequences (MTS). In another embodiment, a mitoTALE comprises a TALE domain fused to an MTS in place of the endogenous LS (localization signal) of the TALE, or into the repeat variable diresidue (RVD) of the TALE. MTS domains can include, but are not limited to, SOD2, Cox8a, bipartitie nuclear localization signals (BPNLS), zmLOC100282174 MLS), which are disclosed herein.

Transcription activator-like effector proteins (TALE proteins) are class of naturally occurring DNA binding proteins which bind specific promoter sequences and which can activate the expression of genes. TALE proteins can be engineered to recognize a desired DNA sequence. TALEs have a modular DNA-binding domain (DBD) consisting of repetitive sequences of amino acids with each repeat region comprising of 34 amino acids. The two amino acids at residue positions 12 and 13 of each repeat region determine the nucleotide specificity of the TALE. This pair of residues is referred to as the repeat variable diresidue (RVD). A final region, known as the half-repeat, is typically truncated to 20 amino acids. Using these factors, one of ordinary skill in the art can sythesize sequence-specific synthetic TALEs, which target user defined nucleotide sequences. See Garg A.: Lohmueller J. J.; Silver P. A.; Armel T. Z. (2012), "Engineering synthetic TAL effectors with orthogonal target sites," *Nucleic Acids Res.* 40, 7584-7595, which is incorporated herein by reference. Further reference to designing sequence specific TALEs can be found in Carlson et al., "Targeting DNA with fingers and TALENs," Mol. Ther. Nucleic Acids, 2012, 1, e3.10.1038/mtna.2011, which is incorporated herein by reference. For example, the C-terminus typically contains a localization signal (LS), which directs a TALE to the particular cellular component (e.g., mitochondria), as well as a functional domain that modulates transcription, such as an acidic activation domain (AD). The endogenous LS can be replaced by an organism-specific localization signal, such as a specific MLS to localize the TALE to the mitochondria. For example, an LS derived from the simian virus 40 large T-antigen can be used in mammalian cells.

mitoZFP

In various embodiments, the mtDNA base editors embrace fusion proteins comprising a DddA (or inactive fragment thereof) and a mitoZFP domain.

A "zinc finger DNA binding protein" or "ZFP" is a protein, or a domain within a larger protein, that binds DNA in a sequence-specific manner through one or more zinc fingers, which are regions of amino acid sequence within the binding domain whose structure is stabilized through coordination of a zinc ion. The term zinc finger DNA binding protein can be abbreviated as zinc finger protein or ZFP. A "mitoZFP" refers to a zinc finger DNA binding protein that has been modified to comprise one or more mitochondral targeting sequences (MTS).

Zinc finger binding domains can be "engineered" to bind to a predetermined nucleotide sequence. Non-limiting examples of methods for engineering zinc finger proteins are design and selection. A designed zinc finger protein is a protein not occurring in nature whose design/composition results principally from rational criteria. Rational criteria for design include application of substitution rules and computerized algorithms for processing information in a database storing information of existing ZFP designs and binding data. See, for example, U.S. Pat. Nos. 6,140.081; 6,453,242; 6,534,261; and 6,785,613; see, also WO 98/53058; WO 98/53059; WO 98/53060: WO 02/016536 and WO 03/016496; and U.S. Pat. Nos. 6,746,838; 6,866,997; and 7,030,215, each of which are incorporated herein by reference.

Zinc-finger nucleases ("ZFNs") are artificial restriction enzymes generated by fusing a zinc finger DNA-binding domain to a DNA-cleavage domain. Zinc finger domains can be engineered to target specific desired DNA sequences and this enables zinc-finger nucleases to target unique sequences within complex genomes.

The DNA-binding domains of individual ZFNs typically contain between three and six individual zinc finger repeats and can each recognize between 9 and 18 basepairs. If the zinc finger domains are perfectly specific for their intended target site then even a pair of 3-finger ZFNs that recognize a total of 18 basepairs can, in theory, target a single locus in a mammalian genome. The most straightforward method to generate new zinc-finger arrays is to combine smaller zinc-finger "modules" of known specificity. The most common modular assembly process involves combining three separate zinc fingers that can each recognize a 3 basepair DNA sequence to generate a 3-finger array that can recognize a 9 basepair target site.

Mitochondrial Targeting Sequence (MTS)

In various embodiments, the mtDNA base editors or the polypeptides that comprise the mtDNA base editors (e.g., the pDNAbps and DddA) may be engineered to include one or more mitochondrial targeting sequences (MTS) (or mitochondrial localization sequence (MLS)) which facilitate that translocation of a polypeptide into the mitochondria. MTS are known in the art and exemplary sequences are provided herein. In general MTSs are short peptide sequences (about 3-70 amino acids long) that direct a newly synthesized protein to the mitochondria within a cell. It is usually found at the N-terminus and consists of an alternating pattern of hydrophobic and positively charged amino acids to form what is called an amphipathic helix. Mitochondrial localization sequences can contain additional signals that subsequently target the protein to different regions of the mitochondria, such as the mitochondrial matrix. One exemplary mitochondrial localization sequence is the mitochondrial localization sequence derived from Cox8, a mitochondrial cytochrome c oxidase subunit VIII. In embodiments, a mitochondrial localization sequence derived from Cox8 includes the amino acid sequence: MSVLTPLLLR-GLTGSARRLPVPRAKIHSL (SEQ ID NO: 299). In the embodiments, the mitochondrial localization sequence derived from Cox8 includes an amino acid sequence that is about 50%, 55%, 60%, 65%, 70%, 75%, 80%, 85%, 90% or 95% identity to SEQ ID NO: 299.

Nucleic Acid Molecule

The term "nucleic acid." as used herein, refers to a polymer of nucleotides. The polymer may include natural nucleosides (i.e., adenosine, thymidine, guanosine, cytidine, uridine, deoxyadenosine, deoxythymidine, deoxyguanosine, and deoxycytidine), nucleoside analogs (e.g., 2-aminoadenosine, 2-thiothymidine, inosine, pyrrolo-pyrimidine. 3-methyl adenosine, 5-methylcytidine, C5 bromouridine, C5 fluorouridine, C5 iodouridine, C5 propynyl uridine, C5 propynyl cytidine, C5 methylcytidine, 7 deazaadenosine, 7 deazaguanosine. 8 oxoadenosine, 8 oxoguanosine, 0(6) methylguanine. 4-acetylcytidine, 5-(carboxyhydroxymethyl)uridine, dihydrouridine, methylpseudouridine, 1-methyl adenosine, 1-methyl guanosine, N6-methyl adenosine, and 2-thiocytidine), chemically modified bases, biologically modified bases (e.g., methylated bases), intercalated bases, modified sugars (e.g., 2'-fluororibose, ribose, 2'-deoxyribose, 2'-O-methylcytidine, arabinose, and hexose), or modified phosphate groups (e.g., phosphorothioates and 5' N phosphoramidite linkages).

Mutation

The term "mutation," as used herein, refers to a substitution of a residue within a sequence. e.g. a nucleic acid or amino acid sequence, with another residue; a deletion or insertion of one or more residues within a sequence; or a substitution of a residue within a sequence of a genome in a subject to be corrected. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press. Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which are mutations that reduce or abolish a protein activity. Most loss-of-function mutations are recessive, because in a heterozygote the second chromosome copy carries an unmutated version of the gene coding for a fully functional protein whose presence compensates for the effect of the mutation. There are some exceptions where a loss-of-function mutation is dominant, one example being haploinsufficiency, where the organism is unable to tolerate the approximately 50% reduction in protein activity suffered by the heterozygote. This is the explanation for a few genetic diseases in humans, including Marfan syndrome, which results from a mutation in the gene for the connective tissue protein called fibrillin. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Alternatively, the mutation could lead to overexpression of one or more genes involved in control of the cell cycle, thus leading to uncontrolled cell division and hence to cancer. Because of their nature, gain-of-function mutations are usually dominant.

napDNAbp

In various embodiments, the mtDNA base editors may comprise pDNAbps which are nucleic acid programmable. The term "napDNAb" which stand for "nucleic acid programmable DNA binding protein" refers to any protein that may associate (e.g., form a complex) with one or more nucleic acid molecules (i.e., which may broadly be referred to as a "napDNAbp-programming nucleic acid molecule" and includes, for example, guide RNA in the case of Cas systems) which direct or otherwise program the protein to localize to a specific target nucleotide sequence (e.g., a gene locus of a genome) that is complementary to the one or more nucleic acid molecules (or a portion or region thereof) associated with the protein, thereby causing the protein to bind to the nucleotide sequence at the specific target site. This term napDNAbp embraces CRISPR-Cas9 proteins, as well as Cas9 equivalents, homologs, orthologs, or paralogs, whether naturally occurring or non-naturally occurring (e.g., engineered or modified), and may include a Cas9 equivalent from any type of CRISPR system (e.g., type II, V, VI), including Cpf1 (a type-V CRISPR-Cas systems), C2c1 (a type V CRISPR-Cas system), C2c2 (a type VI CRISPR-Cas system), C2c3 (a type V CRISPR-Cas system), dCas9, GeoCas9, CjCas9, Cas12a, Cas12b, Cas12c, Cas12d, Cas12g, Cas12h, Cas12i, Cas13d, Cas14, Argonaute, and nCas9. Further Cas-equivalents are described in Makarova et al., "C2c2 is a single-component programmable RNA-guided RNA-targeting CRISPR effector," *Science* 2016; 353 (6299), the contents of which are incorporated herein by reference. However, the nucleic acid programmable DNA binding protein (napDNAbp) that may be used in connection with this invention are not limited to CRISPR-Cas systems. The invention embraces any such programmable protein, such as the Argonaute protein from Natronobacterium gregoryi (NgAgo) which may also be used for DNA-guided genome editing. NgAgo-guide DNA system does not require a PAM sequence or guide RNA molecules, which means genome editing can be performed simply by the expression of generic NgAgo protein and introduction of synthetic oligonucleotides on any genomic sequence. See Gao et al., DNA-guided genome editing using the *Natronohacterium gregoryi* Argonaute. *Nature Biotechnology* 2016; 34(7):768-73, which is incorporated herein by reference.

In some embodiments, the napDNAbp is a RNA-programmable nuclease, when in a complex with an RNA, may be referred to as a nuclease:RNA complex. Typically, the bound RNA(s) is referred to as a guide RNA (gRNA), gRNAs can exist as a complex of two or more RNAs, or as a single RNA molecule, gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 (or equivalent) complex to the target); and (2) a domain that binds a Cas9 protein. In some embodiments, domain (2) corresponds to a sequence known as a tracrRNA, and comprises a stem-loop structure. For example, in some embodiments, domain (2) is homologous to a tracrRNA as depicted in FIG. 1E of Jinek et al., *Science* 337:816-821(2012), the entire contents of which is incorporated herein by reference. Other examples of gRNAs (e.g., those including domain 2) can be found in U.S. Pat. No. 9,340,799, entitled "mRNA-Sensing Switchable gRNAs," and International Patent Application No. PCT/US2014/054247, filed Sep. 6, 2013, published as WO 2015/035136 and entitled "Delivery System For Functional Nucleases," the entire contents of each are herein incorporated by reference. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J, et al.,, *Proc. Natl. Acad. Sci. U.S.A.* 98:4658-4663(2001); "CRISPR RNA maturation by trans-encoded small RNA and host factor RNase III." Deltcheva E, et al., Nature 471:602-607(2011); and "A programmable dual-RNA-guided DNA endonuclease in adaptive bacterial immunity." Jinek M, et al., *Science* 337: 816-821(2012), the entire contents of each of which are incorporated herein by reference.

The napDNAbp nucleases (e.g., Cas9) use RNA:DNA hybridization to target DNA cleavage sites, these proteins are able to be targeted, in principle, to any sequence specified by the guide RNA. Methods of using napDNAbp nucleases, such as Cas9, for site-specific cleavage (e.g., to modify a genome) are known in the art (see e.g., Cong, L, et al. Multiplex genome engineering using CRISPR/Cas systems. Science 339, 819-823 (2013); Mali, P, et al. RNA-guided human genome engineering via Cas9. *Science* 339, 823-826 (2013); Hwang. W. Y. et al. Efficient genome editing in zebrafish using a CRISPR-Cas system. *Nature Biotechnology* 31, 227-229 (2013); Jinek, M, et al. RNA-programmed genome editing in human cells. *eLife* 2, e00471 (2013); Dicarlo, J. E, et al., Genome engineering in *Saccharomyces cerevisiae* using CRISPR-Cas systems. *Nucleic Acid Res*. (2013); Jiang, W, et al. RNA-guided editing of bacterial genomes using CRISPR-Cas systems. Nature Biotechnology 31, 233-239 (2013); the entire contents of each of which are incorporated herein by reference).

Nickase

The term "nickase" refers to a napDNAbp having only a single nuclease activity that cuts only one strand of a target DNA, rather than both strands. Thus, a nickase type napDNAbp does not leave a double-strand break.

Nuclear Localization Signal

In various embodiments, the mtDNA base editors or the polypeptides that comprise the mtDNA base editors (e.g., the pDNAbps and DddA) may be further engineered to include one or more nuclear localization signals.

A nuclear localization signal or sequence (NLS) is an amino acid sequence that tags, designates, or otherwise marks a protein for import into the cell nucleus by nuclear transport. Typically, this signal consists of one or more short sequences of positively charged lysines or arginines exposed on the protein surface. Different nuclear localized proteins may share the same NLS. An NLS has the opposite function of a nuclear export signal (NES), which targets proteins out of the nucleus. Thus, a single nuclear localization signal can direct the entity with which it is associated to the nucleus of a cell. Such sequences may be of any size and composition, for example more than 25, 25, 15, 12, 10, 8, 7, 6, 5, or 4 amino acids, but will preferably comprise at least a four to eight amino acid sequence known to function as a nuclear localization signal (NLS).

Nucleic Acid Molecule

The term "nucleic acid molecule" as used herein, refers to RNA as well as single and/or double-stranded DNA. Nucleic acid molecules may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g. a recombinant DNA or RNA, an artificial chromosome, an engineered genome, or fragment thereof, or a synthetic DNA. RNA, DNA/RNA hybrid, or including non-naturally occurring nucleotides or nucleosides. Furthermore, the terms "nucleic acid," "DNA," "RNA," and/or similar terms include nucleic acid analogs, e.g. analogs having other than a phosphodiester backbone. Nucleic acids may be purified from natural sources, produced using recombinant expression systems and optionally purified, chemically synthesized, etc. Where appropriate, e.g. in the case of chemically synthesized molecules, nucleic acids may comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g. 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine. C5-propynyl-cytidine, C5-methylcytidine, 2-aminoadenosine, 7-deazaadenosine, 7-deazaguanosine, inosinedenosine, 8-oxoguanosine, 0(6)-methylguanine, and 2-thiocytidine); chemically modified bases; biologically modified bases (e.g. methylated bases); intercalated bases; modified sugars (e.g. 2'-fluororibose, ribose, 2'-deoxyribose, arabinose, and hexose); and/or modified phosphate groups (e.g. phosphorothioates and 5'-N-phosphoramidite linkages).

PACE

The term "phage-assisted continuous evolution (PACE)," as used herein, refers to continuous evolution that employs phage as viral vectors. The general concept of PACE technology has been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Pat. No. 9,023,594, issued May 5, 2015, International PCT Application. PCT/US2015/012022, filed Jan. 20, 2015, published as WO 2015/134121 on Sep. 11, 2015, and International PCT Application. PCT/US2016/027795, filed Apr. 15, 2016, published as WO 2016/168631 on Oct. 20, 2016, the entire contents of each of which are incorporated herein by reference. PACE can be used, for instance, to evolve a deaminase (e.g., a cytidine or adenosine deaminase) which uses single strand DNA as a substrate to obtain a deaminase which is capable of using double-strand DNA as a substrate (e.g., DddA).

Programmable DNA Binding Protein (pDNAbp)

As used herein, the term "programmable DNA binding protein," "pDNA binding protein," "pDNA binding protein domain" or "pDNAbp" refers to any protein that localizes to and binds a specific target DNA nucleotide sequence (e.g. a gene locus of a genome). This term embraces RNA-programmable proteins, which associate (e.g, form a complex) with one or more nucleic acid molecules (i.e., which includes, for example, guide RNA in the case of Cas systems) that direct or otherwise program the protein to localize to a specific target nucleotide sequence (e.g., DNA sequence) that is complementary to the one or more nucleic acid molecules (or a portion or region thereof) associated with the protein. The term also embraces proteins which bind directly to nucleotide sequence in an amino acid-programmable manner, e.g., zinc finger proteins and TALE proteins. Exemplary RNA-programmable proteins are CRISPR-Cas9 proteins, as well as Cas9 equivalents, homologs, orthologs, or paralogs, whether naturally occurring or non-naturally occurring (e.g. engineered or modified), and may include a Cas9 equivalent from any type of CRISPR system (e.g. type II, V, VI), including Cpf1 (a type-V CRISPR-Cas systems), C2c1 (a type V CRISPR-Cas system), C2c2 (a type VI CRISPR-Cas system), C2c3 (a type V CRISPR-Cas system), dCas9, GeoCas9, CjCas9, Cas12a, Cas12b, Cas12c, Cas12d. Cas12g, Cas12h, Cas12i, Cas13d, Cas14, Argonaute, and nCas9. Further Cas-equivalents are described in Makarova et al., "C2c2 is a single-component programmable RNA-guided RNA-targeting CRISPR effector," Science 2016; 353(6299), the contents of which are incorporated herein by reference.

Promoter

The term "promoter" is recognized in the art as referring to a nucleic acid molecule with a sequence recognized by the cellular transcription machinery and able to initiate transcription of a downstream (i.e., closer to or toward the 3' end of the nucleic acid strand) gene. A promoter can be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. A subclass of conditionally active promoters are inducible promoters that require the presence of a small molecule "inducer" for activity. Examples of inducible promoters include, but are not limited to, arabinose-inducible promoters, Tet-on promoters, and tamoxifen-inducible promoters. A variety of constitutive, conditional, and inducible promoters are well known to the skilled artisan, and the skilled artisan will be able to ascertain a variety of such promoters useful in carrying out the instant invention, which is not limited in this respect.

Protein, Peptide, and Polypeptide

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified. e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid. The terms "non-naturally occurring amino acid" and "unnatural amino acid" refer to amino acid analogs, synthetic amino acids, and amino acid mimetics which are not found in nature.

Amino acids may be referred to herein by either their commonly known three letter symbols or by the one-letter symbols recommended by the njPAC-R7B Biochemical Nomenclature Commission. Nucleotides, likewise, may be referred to by their commonly accepted single-letter codes. The terms "polypeptide," "peptide" and "protein" are used interchangeably herein to refer to a polymer of amino acid residues, wherein the polymer may in embodiments be conjugated to a moiety that does not consist of amino acids. The terms apply to amino acid polymers in which one or more amino acid residue is an artificial chemical mimetic of a corresponding naturally occurring amino acid, as well as to naturally occurring amino acid polymers and non-naturally occurring amino acid polymers. A "fusion protein" refers to a chimeric protein encoding two or more separate protein sequences that are recombinantly expressed as a single moiety.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention. The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y). Tryptophan (W);
7) Serine (S), Threonine (T); and
8) Cysteine (C), Methionine (M).

RNA-Protein Recruitment System

In various embodiments, two separate protein domains (e.g., a pDNAbp and a DddA or a DddA N-terminal half and a DddA C-terminal half) may be colocalized to one another to form a functional complex (akin to the function of a fusion protein comprising the two separate protein domains) by using an "RNA-protein recruitment system," such as the "MS2 tagging technique." Such systems generally tag one protein domain with an "RNA-protein interaction domain" (aka "RNA-protein recruitment domain") and the other with an "RNA-binding protein" that specifically recognizes and binds to the RNA-protein interaction domain, e.g., a specific hairpin structure. These types of systems can be leveraged to colocalize the domains of a base editor, as well as to recruitment additional functionalities to a base editor, such as a UGI domain. In one example, the MS2 tagging technique is based on the natural interaction of the MS2 bacteriophage coat protein ("MCP" or "MS2cp") with a stem-loop or hairpin structure present in the genome of the phage, i.e., the "MS2 hairpin." In the case of the MS2 hairpin, it is recognized and bound by the MS2 bacteriophage coat protein (MCP). Thus, in one exemplarly scenario a deaminase-MS2 fusion can recruit a Cas9-MCP fusion.

A review of other modular RNA-protein interaction domains are described in the art, for example, in Johansson et al., "RNA recognition by the MS2 phage coat protein," *Sen Virol.,* 1997, Vol. 8(3): 176-185; Delebecque et al., "Organization of intracellular reactions with rationally designed RNA assemblies," *Science,* 2011. Vol. 333: 470-474; Mali et al., "Cas9 transcriptional activators for target specificity screening and paired nickases for cooperative genome engineering," *Nat. Biotechnol.,* 2013. Vol. 31: 833-838; and Zalatan et al., "Engineering complex synthetic transcriptional programs with CRISPR RNA scaffolds," *Cell,* 2015, Vol. 160: 339-350, each of which are incorporated herein by reference in their entireties. Other systems include the PP7 hairpin, which specifically recruits the PCP protein, and the "com" hairpin, which specifically recruits the Corn protein. See Zalatan et al.

The nucleotide sequence of the MS2 hairpin (or equivalently referred to as the "MS2 aptamer") is: GCCAACATGAGGATCACCCATGTCTGCAGGGCC (SEQ ID NO: 25).

The amino acid sequence of the MCP or MS2cp is:

```
                                      (SEQ ID NO: 26)
GSASNFTQFVLVDNGGTGDVTVAPSNFANGVAEWISSNSRSQAYKVT

CSVRQSSAQNRKYTIKVEVPKVATQTVGGEELPVAGWRSYLNMELTI

PIFATNSDCELIVKAMQGLLKDGNPIPSAIAANSGIY.
```

Sense Strand

In genetics, a "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

Split Site (e.g., of a DddA)

As used herein, the term "split site," as in a split site of a DddA, refers to a specific peptide bond between any two immediately adjacent amino acid residues in the amino acid sequence of a DddA at which the complete DddA polypeptide is divided into two half portions, i.e., an N-terminal half portion and a C-terminal half portion. The N-terminal half portion of the DddA may be referred to as "DddA-N half" and the C-terminal half portion of the DddA may be referred to as the "DddA-C half." Alternately, DddA-N half may be referred to as the "DddA-N fragment or portion" and the DddA-C half may be referred to as the "DddA-C fragment of portion." Depending on the location of the split site, the DddA-N half and the DddA-C half may be the same or different size and/or sequence length. The term "half" does not connote the requirement that the DddA-N and DddA-C portions are identically half of the size and/or sequence length of a complete DddA, or that the split site is required to be at the mid point of the complete DddA polypeptide. To the contrary, and as noted above, the split site can be between any pair of residues in the DddA polypeptide, thereby giving rise to half portions which are unequal in size and/or sequence length. For clarity, as used herein, the term "half" when used in the context of a split molecule (e.g., protein, intein, delivery molecule, nucleic acid, etc.), shall not be interpreted to require, and shall not imply, that the size of the resulting portions (e.g., as "split" or broken into smaller portions) of the molecule are one-half (e.g., ½, 50%) of the original molecule. The term shall be interpreted to be illustrative of idea that they are portion(s) of a larger molecule that has been broken into smaller fragments (e.g., portions), but that when reconstituted may regain the activity of the molecule as a whole. Thus, by way of example, a half (e.g., portion) may be any portion of the molecule from which it is obtained (e.g., is less than 100% of the whole of the molecule), such that there is at least one additional portion formed (e.g., a second half, other half, second portion), which also is less than 100% of the whole of the molecule. It is important to note, that the molecule may be formed into additional portions (e.g., third, fourth, etc., halves (e.g., portions)), which is readily envisioned by using the term definition above, and such additional halves to not constitute a molecule larger than or in addition to the whole from which they were derived. Further, it should be noted that in the event there are more than two halves (e.g., two portions) formed from the splitting of a molecule it may only require two of the portions to reconstitute the activity of the molecule as a whole. By way of example, if an enzyme is split into three halves (e.g., three portions), wherein the catalytic domain of the enzyme possessing the enzymatic activity of interest is only split into two halves (e.g., two portions) only the two portions of the catalytic domain may be necessary to be used to carry out the activity of interest. Thus, when referring to using two halves, it is not necessary that the two halves, together, comprise 100% of the whole of the molecule from which they were derived. In certain embodiments, the split site is within a loop region of the DddA.

As used herein, reference to "splitting a DddA at a split site" embraces direct and indirect means for obtaining two half portions of a DddA. In one embodiment, splitting a DddA refers to the direct splitting a DddA polypeptide at a split site in the protein to obtain the DddA-N and DddA-C half portions. For example, the cleaving of a peptide bond between two adjacent amino acid residues at a split site may be achieved by enzymatic or chemical means. In another embodiment, a DddA may be split by engineering separate nucleic acid sequences, each encoding a different half portion of the DddA. Such methods can be used to obtain expression vectors for expressing the DddA half portions in a cell in order to reconstitute the DddA.

Subject

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

Target Site

The term "target site" refers to a sequence within a nucleic acid molecule (e.g., a mtDNA) that is edited by a mtDNA base editor disclosed herein. The target site further refers to the sequence within a nucleic acid molecule to which a complex of the mtDNA base editor binds. In cases wherein the pDNAbp of the mtDNA base editor is a Cas9 domain, typically, the target site is a sequence that includes the unique ~20 bp target specified by the gRNA plus the genomic PAM sequence. CRISPR-Cas9 mechanisms recognize DNA targets that are complementary to a short CRISPR sgRNA sequence. The part of the sgRNA sequence that is complementary to the target sequence is known as a protospacer. In order for Cas9 to function it also requires a specific protospacer adjacent motif (PAM) that varies depending on the bacterial species of the Cas9 gene. The most commonly used Cas9 nuclease, derived from *S. pyogenes*, recognizes a PAM sequence of NGG that is found directly downstream of the target sequence in the genomic DNA, on the non-target strand.

Transition

As used herein, "transitions" refer to the interchange of purine nucleobases (A↔G) or the interchange of pyrimidine nucleobases (C↔T). This class of interchanges involves nucleobases of similar shape. The compositions and methods disclosed herein are capable of inducing one or more transitions in a target DNA molecule. The compositions and methods disclosed herein are also capable of inducing both transitions and transversion in the same target DNA molecule. These changes involve A↔G, G↔A, C↔T, or T↔C. In the context of a double-strand DNA with Watson-Crick paired nucleobases, transitions refer to the following base pair exchanges: A:T↔G:C, G:G↔A:T, C:G↔T:A, or T:A↔C:G. The compositions and methods disclosed herein are capable of inducing one or more transitions in a target DNA molecule. The compositions and methods disclosed herein are also capable of inducing both transitions and transversion in the same target DNA molecule, as well as other nucleotide changes, including deletions and insertions.

Transversion

As used herein, "transversions" refer to the interchange of purine nucleobases for pyrimidine nucleobases, or in the reverse and thus, involve the interchange of nucleobases with dissimilar shape. These changes involve T↔A, T↔G, C↔G, C↔A, A↔T, A↔C, G↔C, and G↔T. In the context of a double-strand DNA with Watson-Crick paired nucleobases, transversions refer to the following base pair exchanges: T:A↔A:T, T:A↔G:C, C:G↔G:C, C:G↔A:T, A:T↔T:A, A:T↔C:G, G:C↔C:G, and G:C↔T:A. The compositions and methods disclosed herein are capable of inducing one or more transversions in a target DNA molecule. The compositions and methods disclosed herein are also capable of inducing both transitions and transversion in the same target DNA molecule, as well as other nucleotide changes, including deletions and insertions.

Treatment

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat." and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Upstream

As used herein, the terms "upstream" and "downstream" are terms of relativity that define the linear position of at least two elements located in a nucleic acid molecule (whether single or double-stranded) that is orientated in a 5'-to-3' direction. In particular, a first element is upstream of a second element in a nucleic acid molecule where the first element is positioned somewhere that is 5' to the second element. For example, a SNP is upstream of a Cas9-induced nick site if the SNP is on the 5' side of the nick site. Conversely, a first element is downstream of a second element in a nucleic acid molecule where the first element is positioned somewhere that is 3' to the second element. For example, a SNP is downstream of a Cas9-induced nick site if the SNP is on the 3' side of the nick site. The nucleic acid molecule can be a DNA (double or single stranded). RNA (double or single stranded), or a hybrid of DNA and RNA. The analysis is the same for single strand nucleic acid molecule and a double strand molecule since the terms upstream and downstream are in reference to only a single strand of a nucleic acid molecule, except that one needs to select which strand of the double stranded molecule is being considered. Often, the strand of a double stranded DNA which can be used to determine the positional relativity of at least two elements is the "sense" or "coding" strand. In genetics, a "sense" strand is the segment within double-stranded DNA that runs from 5' to 3', and which is complementary to the antisense strand of DNA, or template strand, which runs from 3' to 5'. Thus, as an example, a SNP nucleobase is "downstream" of a promoter sequence in a genomic DNA (which is double-stranded) if the SNP nucleobase is on the 3' side of the promoter on the sense or coding strand.

Uracil Glycosylase Inhibitor

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 27. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 27. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 27. In some embodiments, a UGI comprises an amino acid sequence homologous to the amino acid sequence set forth in SEQ ID NO: 27, or an amino acid sequence homologous to a fragment of the amino acid sequence set forth in SEQ ID NO: 27. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 27. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 27. In some embodiments, the UGI comprises the following amino acid sequence: MTNLSDIIEKETGKQLVIQE-SILMLPEEVEEVIGNKPESDILVHTAYDEST- DENVMLLTSD APEYKPWALVIQDSNGENKIKML (SEQ ID NO: 27) (P14739|UNGI_BPPB2 Uracil-DNA glycosylase inhibitor), or the same sequence but without the N-terminal methionine.

Other UGI proteins may include those described in Example 6, as follows:

| UGI | Sequence | SEQ ID NO: |
|---|---|---|
| Canonical UGI | TNLSDIIEKETGKQLVIQESILMLPEEVE EVIGNKPESDILVHTAYDESTDENVMLLT SDAPEYKPWALVIQDSNGENKIKML | 341 |
| UGI2 | MTLELQLKHYITNLFNLPKDEKWHCESIE EIADDILPDQYVRLGALSNKILQTYTYYS DTLHESNIYPFILYYQKQLIAIGYIDENH DMDFLYLHNTIMPLLDQRYLLTGGQ | 445 |
| UGI3 | MNKNFDEVKADLRTVTGKKIEFKERLKNI LRVQMNQLGFEDSYMIQVQVSSDQEEWVE CHENMSLSDFEVMYGNISGEIKRMTVVKY EEANIEKLVELKFEYEYAKAHQEYIRAYT KLMSNTLYGRKPSL | 446 |
| UGI5 | MNEEKMHYRDAIKEVELTMMSLDSHFRTH KEFTDSYLLVLILEDVVGETRVEVSEGLT FDEASYIIGGTSDNILNMHMINYCEKNRE EIYKWLKVSRVNTFKSNYAKMLLNTAYGK DLLKGVVK | 447 |
| UGI7 | MNNHFMSIGRNCSKCNNVRLNEDFSKSEE ICNECFDKEERFVDSYTLIYITEDETGKR FEAILENQTIEETEIIYGNIIDKIIVWNV ILTM | 556 |
| UGI12 | DGNEHWEVHPGLSLSDFEVVYGNNPHQIV KLRLDKEVGGSGGSMVQNDFIDSYTLCWL LRDDSGGGGSMVQNDFIDSYTLCWLLRDD DGNEHWEVHPGLSLSDFEVVYGNNPHQIV KLRLDKEV | 376 |

Variant

In various embodiments, the mtDNA base editors or the polypeptides that comprise the mtDNA base editors (e.g., the pDNAbps and DddA) may be engineered as variants.

As used herein, the term "variant" refers to a protein having characteristics that deviate from what occurs in nature that retains at least one functional i.e. binding, interaction, or enzymatic ability and/or therapeutic property thereof. A "variant" is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the wild type protein. For instance, a variant of Cas9 may comprise a Cas9 that has one or more changes in amino acid residues as compared to a wild type Cas9 amino acid sequence. As another example, a variant of a deaminase may comprise a deaminase that has one or more changes in amino acid residues as compared to a wild type deaminase amino acid sequence, e.g. following ancestral sequence reconstruction of the deaminase. These changes include chemical modifications, including substitutions of different amino acid residues truncations, covalent additions (e.g. of a tag), and any other mutations. The term also encompasses circular permutants, mutants, truncations, or domains of a reference sequence, and which display the same or substantially the same functional activity or activities as the reference sequence. This term also embraces fragments of a wild type protein.

The level or degree of which the property is retained may be reduced relative to the wild type protein but is typically the same or similar in kind. Generally, variants are overall very similar, and in many regions, identical to the amino acid sequence of the protein described herein. A skilled artisan will appreciate how to make and use variants that maintain all, or at least some, of a functional ability or property.

The variant proteins may comprise, or alternatively consist of, an amino acid sequence which is at least 80%, 85%, 90%, 95%, 96%, 97%, 98%, 99%, or 100%, identical to, for example, the amino acid sequence of a wild-type protein, or any protein provided herein (e.g. DddA).

By a polypeptide having an amino acid sequence at least, for example, 95% "identical" to a query amino acid sequence, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino- or carboxy-terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98%, or 99% identical to, for instance, the amino acid sequence of a protein such as a DddA protein, can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (*Comp. App. Biosci.* 6:237-245 (1990)). In a sequence alignment the query and subject sequences are either both nucleotide sequences or both amino acid sequences. The result of said global sequence alignment is expressed as percent identity. Preferred parameters used in a FASTDB amino acid alignment are: Matrix=PAM 0, k-tuple=2, Mismatch Penalty=1, Joining Penalty=20, Randomization Group Length=0, Cutoff Score=l, Window Size=sequence length. Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

Vector

The term "vector," as used herein, refers to a nucleic acid that can be modified to encode a gene of interest and that is able to enter into a host cell, mutate and replicate within the host cell, and then transfer a replicated form of the vector into another host cell. Exemplary suitable vectors include viral vectors, such as retroviral vectors or bacteriophages and filamentous phage, and conjugative plasmids. Additional suitable vectors will be apparent to those of skill in the art based on the instant disclosure.

Wild Type

As used herein the term "wild type" is a term of the art understood by skilled persons and means the typical form of an organism, strain, gene or characteristic as it occurs in nature as distinguished from mutant or variant forms.

These and other exemplary embodiments are described in more detail in the Detailed Description, Examples, and claims. The invention is not intended to be limited in any manner by the above exemplary embodiments.

DETAILED DESCRIPTION OF CERTAIN EMBODIMENTS

Each mammalian cell contains hundreds to thousands of copies of a circular mtDNA[10]. Homoplasmy refers to a state in which all mtDNA molecules are identical, while heteroplasmy refers to a state in which a cell contains a mixture of wild-type and mutant mtDNA. Current approaches to engineer mtDNA rely on DNA-binding proteins such as transcription activator-like effectors nucleases (mitoTALENs)[11-17] and zinc finger nucleases (mitoZFNs)[18-20] fused to mitochondrial targeting sequences to induce double-strand breaks (DSBs). Such proteins do not rely on nucleic acid programmability (e.g., such as with Cas9 domains). Linearized mtDNA is rapidly degraded,[21-23] resulting in heteroplasmic shifts to favor uncut mtDNA genomes. As a candidate therapy however, this approach cannot be applied to homoplasmic mtDNA mutations[24] since destroying all mtDNA copies is presumed to be harmful.[22,25] In addition, using DSBs to eliminate heteroplasmic mtDNA mutations, which tend to be functionally recessive,[26] implicitly requires the edited cell to restore its wild-type mtDNA copy number. During this transient period of mtDNA repopulation, the loss of mtDNA copies could result in cellular toxicity.

The present disclosure relates in part to the inventors' discovery of a double-stranded DNA deaminase, referred to herein as "DddA," and to its application in base editing of double-stranded nucleic acid molecules, and in particular, the editing of mitochondrial DNA.

Accordingly, the disclosure provides a novel platform of precision genome editing using a double-stranded DNA deaminase (DddA) and a programmable DNA binding protein (pDNAbp), such as a TALE domain, zinc finger binding domain, or a napDNAbp (e.g., Cas9), to target the deamination of a target base, which through cellular DNA repair and/or replication, is converted to a new base, thereby installing a base edit at a target site. In some embodiments, the deaminase activity is a cytidine deminase, which deaminates a cytidine, leading to a C-to-T edit at that site. In some other embodiments, that deaminase activity is an adenosine deminase, which deaminates an adenosine, leading to a A-to-G edit at that site. In various embodiments, the disclosure further relates to "split-constructs" and "split-delivery" of said constructs whereby to address the toxic nature of fully active DddA in cells (as discovered by the inventors), the DddA protein is "split" or otherwise divided into two or more DddA fragments which can be separately delivered, expressed, or otherwise provided to cells to avoid the toxicity of fully active DddA. Further, the DddA fragments may be delivered, expressed, or otherwise provided as separate fusion proteins to cells with programmable DNA binding proteins (e.g., zinc finger domains, TALE domains, or Cas9 domains) which are programmed to localize the DddA fragments to a target edit site, through the binding of the DNA binding proteins to DNA sites upstream and downstream of the target edit site. Once co-localized to the target edit site, the separately provided DddA fragments may associate (covalently or non-covalently) to reconstitute an active DddA protein with a double-stranded DNA deaminase activity. In certain embodiments where the objective is to base edit mitochondrial DNA targets, the programmable DNA binding proteins can be modified with one or more mitochondrial localization signals (MLS) so that the DddA-pDNAbp fusions are translocated into the mitochondria, thereby enabling them to act on mtDNA targets.

The inventors are believed to be the first to identify DddA, initially being discovered as a bacterial toxin. The inventors further conceived of the idea of splitting the DddA into two or more domains, which apart do not have a deaminase activity (and as such, lack toxicity), but which may be reconstituted to restore the deaminase activity of the protein. This allows the separate delivery DddA fragments to cells, or delivery of nucleic acid molecules expressing such DddA fragments to a cell, such that once present or expressed within a cell, DddA fragments may associate with one another By "associate" it is meant the two or more DddA fragments may come into contact with one another (e.g., in a cell) and form a functional DddA protein within a cell. The association of the two or more fragments may be through covalent interactions or non-covalent interactions. In addition, the DddA domains may be fused or otherwise non-covalently linked to a programmable DNA binding protein, such as a Cas9 domain or other napDNAbp domain, zinc finger domain or protein (ZF, ZFD, or ZFP), or a transcription activator-like effector protein (TALE), which allows for the co-localization of the two or more DddA fragments to a particular desired site in a target nucleic acid molecule which is to be edited, such that when the DddA fragments are co-localized at the desired editing site, they reform a functional DddA that is capable deaminating a target site on a double-stranded DNA molecule. In certain embodiments, the programmable DNA binding proteins can be engineered to comprise one or more mitochondrial localization signals (MLS) such the DddA domains become translocated into the mitochondria, thereby providing a means by which to conduct base editing directly on the mitochondrial genome.

FIG. 1A is a schematic representation of a naturally occurring DddA, an interbacterial toxin discovered by the inventors which was found to catalyze deamination of cytidines within double-stranded DNA as a substrate. The inventors are believed to be the first to identify such a deaminase. However, in its naturally occurring form, the inventors discovered that DddA is toxic to cells. The inventors have conceived of the idea of using the DddA in the context of base editing to deaminate a nucleobase at a target edit site.

In the context of base editing, all previously described cytidine deaminases utilize single-stranded DNA as a substrate (e.g., the R-loop region of a Cas9-gRNA/dsDNA complex). Base editing in the context of mitochondrial DNA has not heretofore been possible due to the challenges of introducing and/or expressing the gRNA needed for a Cas9-based system into mitochondria. The inventors have recognized for the first time that the catalytic properties of DddA can be leveraged to conduct base editing directly on a double strand DNA substrate by separating the DddA into inactive portions, which when co-localized within a cell will become reconstituted as an active DddA. This avoids or at least minimizes the toxicity associated with delivering and/or expressing a fully active DddA in a cell.

For example, a DddA may be divided into two fragments at a "split site," i.e., a peptide bond between two adjacent residues in the primary structure or sequence of a DddA. The split site may be positioned anywhere along the length of the DddA amino acid sequence, so long as the resulting fragments do not on their own possess a toxic property (which could be a complete or partial deaminase activity). In certain embodiments, the split site is located in a loop region of the DddA protein. In the embodiment shown in FIG. 1A, the arrows depict five possible split sites approximately equally spaced along the length of the DddA protein. The depicted embodiment further shows that the DddA was divided into two fragments at a split site located approximately in the middle of the DddA amino acid sequence. The DddA fragment lying to the left of the split site may be referred to as the "N-terminal DddA half" and the DddA fragment lying to the right of the split site may be referred to as the "C-terminal DddA half." FIG. 1A identifies these fragments as "DddA half$^{A}$" and DddA half$^{B}$," respectively. Depending on the location of the split site, the N-terminal DddA half and the C-terminal DddA half could be the same size, approximately the same size, or very different sizes.

Accordingly, this disclosure provides compositions, kits, and methods of modifying double-stranded DNA (e.g., mitochondrial DNA or "mtDNA") using genome editing strategies that comprise the use of a programmable DNA binding protein ("pDNAbp") (e.g., a mitoTALE, mitoZFP, or a CRISPR/Cas9) and a double-stranded DNA deaminase ("DddA") to precisely install nucleotide changes and/or correct pathogenic mutations in double-stranded DNA (e.g., mtDNA), rather than destroying the DNA (e.g., mtDNA) with double-strand breaks (DSBs). The present disclosure provides pDNAbp polypeptides, DddA polypeptides, fusion proteins comprising pDNAbp polypeptides and DddA polypeptides, nucleic acid molecules encoding the pDNAbp polypeptides, DddA polypeptides, and fusion proteins described herein, expression vectors comprising the nucleic acid molecules described herein, cells comprising the nucleic acid molecules, expression vectors, pDNAbp polypeptides, DddA polypeptides, and/or fusion proteins described herein, pharmaceutical compositions comprising the polypeptides, fusion proteins, nucleic acid molecules, vectors, or cells described herein, and kits comprising the polypeptides, fusion proteins, nucleic acid molecules, vectors, or cells described herein for modifying double-stranded DNA (e.g., mtDNA) by base editing.

Mitochondrial diseases (e.g., MELAS/Leigh syndrome and Leber's hereditary optic neuropathy) are diseases often resulting from errors or mutations in the mitochondrial DNA (mtDNA). In many cases, the mutated mtDNA co-exists with the wild-type mtDNA (mtDNA heteroplasmy). In such instances, residual wild type mtDNA can partially compensate for the mutation before biochemical and clinical manifestations occur. Multiple approaches to reduce the levels of mutant mtDNA have been tried. None of these approaches, however, have been successful in treating or correcting these abnormalities. The present disclosure, including the disclosed DddA/pDNAbp fusion proteins, nucleic acid molecules and vectors encoding same can be used to treat one or more mitochondrial diseases, which can include, but are not limited to: Alper's Disease, Autosomal Dominant Optic Atrophy (ADOA), Barth Syndrome, Carnitine Deficiency, Chronic Progressive External Ophthalmoplegia (CPEO), Co-Enzyme Q10 Deficiency. Creatine Deficiency Syndrome, Fatty Acid Oxidation Disorders, Friedreich's Ataxia. Kearns-Sayre Syndrome (KSS), Lactic Acidosis, Leber Hereditary Optic Neuropathy (LHON), Leigh Syndrome, MELAS. Mitochondrial Myopathy. Multiple Mitochondrial Dysfunction Syndrome, Primary Mitochondrial Myopathy, and TK2d, among others.

The present disclosure addresses many of the shortcomings of the exisiting technologies with a new precision mtDNA editing fusion protein and technique. The proposed technology permits the editing (e.g., deamination) of single, or multiple, nucleotides in the mtDNA allowing for the correction or modification of the nucleotide, and by extension the codon in which it is contained. In various embodiment, however, the present disclosure is not limited to editing mtDNA, but may also be used to target the editing of any double-stranded DNA in the cell, including the genomic DNA in the nucleus.

mtDNA BEs

Provided herein are base editor fusion proteins, vectors and nucleic acid molecule encoding base editor fusion proteins, kits, and methods of modifying mitochondrial DNA (mtDNA) using genome editing strategies that comprise the use of a programmable DNA binding protein ("pDNAbp") (e.g., a mitoTALE, mitoZFP, or a CRISPR/Cas9) and a double-stranded DNA deaminase ("DddA") to precisely install nucleotide changes and/or correct pathogenic mutations in mtDNA, rather than destroying the mtDNA with double-strand breaks (DSBs). In various embodiments, these polypeptides may be combined as fusion proteins referred to as "mtDNA base editors." In various embodiments, that base editor fusion proteins may be provided as separate components, i.e., not as a fusion protein, but rather as separate pDNAbp and DddA domains which associate in the cell to target the desired edit site.

Also provided herein are base editor fusion proteins, vectors and nucleic acid molecule encoding base editor fusion proteins, kits, and methods of modifying any double-stranded DNA (e.g., genomic DNA) using genome editing strategies that comprise the use of a programmable DNA binding protein ("pDNAbp") (e.g., a mitoTALE, mitoZFP, or a CRISPR/Cas9) and a double-stranded DNA deaminase ("DddA") to precisely install nucleotide changes and/or correct pathogenic mutations in double-stranded DNA, rather than destroying the DNA with double-strand breaks (DSBs). In various embodiments, that base editor fusion proteins may be provided as separate components, i.e., not as a fusion protein, but rather as separate pDNAbp and DddA domains which associate in the cell to target the desired edit site.

The present disclosure provides mtDNA base editors, pDNAbp polypeptides, DddA polypeptides, nucleic acid molecules encoding the pDNAbp polypeptides. DddA polypeptides, and fusion proteins described herein, expression vectors comprising the nucleic acid molecules, cells comprising the nucleic acid molecules, expression vectors, and/or pDNAbp polypeptides, DddA polypeptides, or fusion proteins, pharmaceutical compositions comprising the polypeptides, fusion proteins, nucleic acid molecules, vectors, or the cells described herein, and kits comprising the polypeptides, fusion proteins, nucleic acid molecules, vectors, or the cells described herein for modifying mtDNA by base editing.

In some embodiments, the mtDNA base editors comprise a pDNAbp (e.g., a mitoTALE, mitoZFP, or a CRISPR/Cas) and a DddAs (or inactive fragment there). In other embodiments, the mtDNA base editors comprise separately expressed pDNAbps and DddAs, which may be co-localized at a desired target site through the use of split-intein sequences, RNA-protein recruitment systems, or other elements that facilitate the co-localization of separately expressed elements to a target site. In various other embodiments, the fusion proteins and/or the separately expressed pDNAbps and DddAs become translocated into the mitochondria. To effect translocation, the fusion proteins and/or the separately expressed pDNAbps and DddAs can comprise one or more mitochondrial targeting sequences (MTS).

In still other embodiments, the mtDNA base editors comprise a DddA domain which has been inactivated. In one embodiment, this inactivation can be achieved by engineering a whole DddA polypeptide into two or more fragments, each alone which is inactive and non-toxic to a cell. When the DddA inactive fragments become co-localization in the cell, e.g., inside the mitochondria, the fragments reconstitute the deaminase activity. The co-localization of the DddA fragments can be effectuated by fusing each DddA fragment to a separate pDNAbp that binds on either one side or the other of a target deamination site. For example, the embodiments depicted in FIG. 1A-1F show that splitting the DddA at a split site into two inactive DddA fragments (e.g., "DddA half$^{A}$" and "DddA half$^{B}$") result in a non-toxic form of DddA. FIG. 1B shows that each of the inactive DddA fragments may be separately expressed as a fusion protein with a pDNAbp which binds to separate target sites on either side of a target deamination site. In FIG. 1B, these target sites are represented by "target site A" and "target site B". By binding the pDNAbp domain of each of the fusion protein to their respective sites, the inactive DddA fragments become co-localized at the desired deamination site, thereby restoring the deaminase activity of the original DddA enzyme. FIGS. 1C, 1D, and 1E show this arrangement in the context of a mitoTALE, mitoZFP, and a Cas9/sgRNA complex as the pDNAbp domain of the mtDNA base editors.

In certain embodiments, the reconstituted activity of the co-localized two or more fragments can comprise at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or at least 99.9% of the deaminase activity of a wildtype DddA.

In terms of the spacing between the target site A and target site B from the site of deamination, any suitable spacing may be used, and which may be further dependent on the length of the linkers (if present) between the pDNAbp and the DddA domains, as well as the properties of the DddA domains. If the target nucleobase site (C on the deamination strand or a G:C nucleobase pair if referring to both strands) is assigned an arbitrary value of 0, then 3'-most position of target site A, in various embodiments, may be spaced at least 1 nucleotide upstream of the target G:C nucleobase pair, or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides upstream of the G:C nucleobase pair (or otherwise the target site of deamination). Likewise, the 3'-most position of target site B (i.e., which is on the opposite strand in this instance), may be spaced at least 1 nucleotide upstream of the target G:C nucleobase pair, or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48,49, 50, 51, 52, 53, 54, 55, 56, 57, 58, 59, 60, 61, 62, 63, 64,65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides upstream of the G:C nucleobase pair (or otherwise the target site of deamination).

Looking at FIG. 1B-1F as a point of reference, it is also contemplated herein that target site A and target site B may be on the same strand of DNA. That is, the inactive DddA fragments may become co-localized at the desired site of deamination by using a pair of mtDNA base editor fusion proteins having pDNAbp components (e.g., mitoTALEs, mitoZFP, Cas9 domains) that both bind to target sites A and B on the same strand. In the case where a pair of mtDNA base editors bind to the same strand of DNA at separate target sites, the strand of DNA containing the target sites can be the same strand at the site of deamination, or the strand can be the opposite strand. So long as the inactive DddA fragments become co-localized at the intended site of deamination, the pair of base editor fusion proteins may bind to target sites on the same strands or opposite strands, and when binding to the same strand, the target sites can be the same or the opposite strand as the strand having the site of deamination.

In certain embodiments, the DddA can be separated into two fragments by dividing the DddA at a split site. A "split site" refers to a position between two adjacent amino acids (in a wildtype DddA amino acid sequence) that marks a point of division of a DddA. In certain embodiments, the DddA can have a least one split site, such that once divided at that split site, the DddA forms an N-terminal fragment and a C-terminal fragment. The N-terminal and C-terminal fragments can be the same or difference sizes (or lengths), wherein the size and/or polypeptide length depends on the location or position of the split site. As used herein, reference to a "fragment" of DddA (or any other polypeptide) can be referred equivalently as a "portion." Thus, a DddA which is divided at a split site can form an N-terminal portion and a C-terminal portion. Preferably, the N-terminal fragment (or portion) and the C-terminal fragment (or portion) or DddA do not have a deaminase activity.

In various embodiments, a DddA may be split into two or more inactive fragments by directly cleaving the DddA at one or more split sites. Direct cleaving can be carried out by a protease (e.g., trypsin) or other enzyme or chemical reagent. In certain embodiments, such chemical cleavage reactions can be designed to be site-selective (e.g., Elashal and Raj, "Site-selective chemical cleavage of peptide bonds," *Chemical Communications,* 2016, Vol. 52, pages 6304-6307, the contents of which are incorporated herein by reference.) In other embodiments, chemical cleavage reactions can be designed to be non-selective and/or occur in a random fashion.

In other embodiments, the two or more inactive DddA fragments can be engineered as separately expressed polypeptides. For instance, for a DddA having one split site, the N-terminal DddA fragment could be engineered from a first nucleotide sequence that encodes the N-terminal DddA fragment (which extends from the N-terminus of the DddA up to and including the residue on the amino-terminal side of the split site). In such an example, the C-terminal DddA fragment could be engineered from a second nucleotide sequence that encodes the C-terminal DddA fragment (which extends from the carboxy-terminus of the split site up to including the natural C-terminus of the DddA protein). The first and second nucleotide sequences could be on the same or different nucleotide molecules (e.g., the same or different expression vectors).

In various embodiments, that N-terminal portion of the DddA may be referred to as "DddA-N half" and the C-terminal portion of the DddA may be referred to as the "DddA-C half." Reference to the term "half" does not connote the requirement that the DddA-N and DddA-C portions are identically half of the size and/or sequence length of a complete DddA, or that the split site is required to be at the mid point of the complete DddA polypeptide. To the contrary, and as noted above, the split site can be between any pair of residues in the DddA polypeptide, thereby giving rise to half portions which are unequal in size and/or sequence length. In certain embodiments, the split site is within a loop region of the DddA.

Accordingly, in one aspect, the disclosure relates to a pair of fusion proteins useful for making modifications to the sequence of mitochondrial DNA (e.g., mtDNA). The pair of fusion proteins, in some embodiments, can comprise a first fusion protein comprising a first pDNAbp (e.g., a mitoTALE, mitoZFP, or a CRISPR/Cas9) and a first portion or fragment of a DddA, and a second fusion protein comprising a second pDNAbp (e.g., mitoTALE, mitoZFP, or a CRISPR/Cas9) and a second portion or fragment of a DddA, such that the first and the second portions of the DddA reconstitute a DddA upon co-localization in a cell and/or mitochondria. In certain embodiments, that first portion of the DddA is an N-terminal fragment of a DddA and the second portion of the DddA is C-terminal fragment of a DddA. In other embodiments, the first portion of the DddA is a C-terminal fragment of a DddA and the second portion of the DddA is an N-terminal fragment of a DddA. In this aspect, the structure of the pair of fusion proteins can be, for example:

[pDNAbp]-[DddA half$^A$] and [pDNAbp]-[DddA half$^B$];
[DddA-half$^A$]-[pDNAbp] and [DddA-half$^B$]-[pDNAbp];
[pDNAbp]-[DddA half$^A$] and [DddA-half$^B$]-[pDNAbp]; or
[DddA-half$^A$]-[pDNAbp] and [pDNAbp]-[DddA half$^B$], wherein "A" or "B" can be the N-terminal or C-terminal half of DddA.

In another aspect, the disclosure relates to a pair of fusion proteins useful for making modifications to the sequence of mitochondrial DNA (e.g., mtDNA). The pair of fusion proteins can comprise a first fusion protein comprising a first mitoTALE and a first portion or fragment of a DddA, and a second fusion protein comprising a second mitoTALE and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoTALE]-[DddA half$^A$] and [mitoTALE]-[DddA half$^B$];
[DddA-half$^A$]-[pDNAbp] and [DddA-half$^B$]-[mitoTALE];
[mitoTALE]-[DddA half$^A$] and [DddA-half$^B$]-[mitoTALE]; or
[DddA-half$^A$]-[mitoTALE] and [mitoTALE]-[DddA half$^B$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first mitoZFP and a first portion or fragment of a DddA, and a second fusion protein comprising a second mitoZFP and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoZFP]-[DddA half$^A$] and [mitoZFP]-[DddA half$^B$];
[DddA-half$^A$]-[pDNAbp] and [DddA-half$^B$]-[mitoZFP];
[mitoZFP]-[DddA half$^A$] and [DddA-half$^B$]-[mitoZFP]; or
[DddA-half$^A$]-[mitoZFP] and [mitoZFP]-[DddA half$^B$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first Cas9 and a first portion or fragment of a DddA, and a second fusion protein comprising a second Cas9 and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA (i.e., "DddA half$^A$" as shown in FIGS. 1A-1E) and the second portion of the DddA is C-terminal fragment of a DddA (i.e., "DddA half$^B$" as shown in FIGS. 1A-1E). In other embodiments, the first portion of the DddA is an C-terminal fragment of a DddA and the second portion of the DddA is an N-terminal fragment of a DddA. In this aspect, the structure of the pair of fusion proteins can be, for example:

[Cas9]-[DddA half$^A$] and [Cas9]-[DddA half$^B$];
[DddA-half$^A$]-[Cas9] and [DddA-half$^B$]-[Cas9];
[Cas9]-[DddA half$^A$] and [DddA-half$^B$]-[Cas9]; or
[DddA-half$^A$]-[Cas9] and [Cas9]-[DddA half$^B$], wherein "A" or "B" can be the N-terminal or C-terminal half of DddA.

In each instance above of "]-[" can be in reference to a linker sequence.

In addition, the fusion proteins may have any suitable architecture, include any those depicted in FIG. 1F.

In some embodiments, a first fusion protein comprises, a first mitochondrial transcription activator-like effector (mitoTALE) domain and a first portion of a DNA deaminase effector (DddA). In some embodiments, the first portion of the DddA comprises an N-terminal truncated DddA. In some embodiments, the first mitoTALE is configured to bind a first nucleic acid sequence proximal to a target nucleotide. In some embodiments, the first portion of a DddA is linked to the remainder of the first fusion protein by the C-terminus of the first portion of a DddA.

In one aspect, the present disclosure provides mitochondrial DNA editor fusion proteins for use in editing mitochondrial DNA. As used herein, these mitochondrial DNA editor fusion proteins may be referred to as "mtDNA editors" or "mtDNA editing systems."

In various embodiments, the mtDNA editors described herein comprise (1) a programmable DNA binding protein ("pDNAbp") (e.g., a mitoTALE domain, mitoZFP domain, or a CRISPR/Cas9 domain) and a double-stranded DNA deaminase domain, which is capable of carrying out a deamination of a nucleobase at a target site associated with the binding site of the programmable DNA binding protein (pDNAbp).

In some embodiments, the double-stranded DNA deaminase is split into two inactive half portions, with each half portion being fused to a programmable DNA binding protein that binds to a nucleotide sequence either upstream or downstream of a target edit site, and wherein once in the mitochondria, the two half portions (i.e., the N-terminal half and the C-terminal half) reassociate at the target edit site by the co-localization of the programmable DNA binding proteins to binding sites upstream and downstream of the target edit site to be acted on by the DNA deaminase. The reassociation of the two half portions of the double-stranded DNA deaminase restores the deaminase activity at the target edit site. In other embodiments, the double-stranded DNA deaminase can initially be set in an inactive state which can be induced when in the mitochondria. The double-stranded DNA deaminase is preferably delivered initially in an inactive form in order to avoid toxicity inherent with the protein. Any means to regulate the toxic properties of the double-stranded DNA deaminase until such time as the activity is desired to be activated (e.g., in the mitochondria) is contemplated.

The mtDNA base editors described herein contemplate fusion proteins comprising a mitoTALE and a DddA domain or fragment or portion thereof (e.g., an N-terminal or C-terminal fragment or portion of a DddA), and optionally the joining of the two by a linker. The application contemplates any suitable mitoTALE and a DddA domain to be combined in a single fusion protein. Examples of mitoTALEs and DddA domains are each defined herein.

In some embodiments, a first fusion protein comprises a first portion of a DddA fused (e.g., attached) to a first mitoTALE. In some embodiments, a second fusion protein comprises a second portion of a DddA fused (e.g., attached) to a second mitoTALE. In some embodiments, the first fusion protein comprises a first portion of a DddA linked to the remainder of the first fusion protein by the C-terminus of the first portion of a DddA. In some embodiments, a second fusion protein comprises a second portion of a DddA linked to the remainder of the second fusion protein by the C-terminus of the second portion of a DddA.

In some embodiments, the first fusion protein comprises a first mitoTALE to bind a target nucleic acid sequence proximal (as defined herein above) to the target nucleotide. In some embodiments, the second fusion protein comprises a mitoTALE to bind a target nucleic acid sequence proximal to the nucleotide complementary to the target nucleotide. In some embodiments, the first and second mitoTALEs are configured to bind proximally to the same target nucleotide (or nucleotide complementary thereto, as described herein above). In some embodiments, the first and second fusion proteins comprise mitoTALEs configured to bind first and second target nucleic acid sequences such that the first and second portions of DddA can dimerize (i.e., re-assemble) at or near the target nucleotide, such that re-assembled first and second portions of a DddA regain, at least partially, the native activity (e.g., deamination) of a full-length DddA. In some embodiments, the first and second fusion proteins comprise mitoTALEs configured to bind first and second target nucleic acid sequences such that that the first and second portions of a DddA can dimerize (i.e., re-assemble) at or near the target nucleotide, such that the target nucleotide is affected by activity of a re-assembled first and second portions of a DddA. Any suitable architecture of the fusion proteins comprising mitoTALEs are contemplated, and shows in FIG. 1F.

The mtDNA base editors described herein also contemplate fusion proteins comprising a mitoZF and a DddA domain or fragment or portion thereof (e.g., an N-terminal or C-terminal fragment or portion of a DddA), and optionally the joining of the two by a linker. The application contemplates any suitable mitoZF and a DddA domain to be combined in a single fusion protein. Examples of mitoZFs and DddA domains are each defined herein.

In some embodiments, a first fusion protein comprises a first portion of a DddA fused (e.g., attached) to a first mitoZF. In some embodiments, a second fusion protein comprises a second portion of a DddA fused (e.g., attached) to a second mitoZF. In some embodiments, the first fusion protein comprises a first portion of a DddA linked to the remainder of the first fusion protein by the C-terminus of the first portion of a DddA. In some embodiments, a second fusion protein comprises a second portion of a DddA linked to the remainder of the second fusion protein by the C-terminus of the second portion of a DddA.

In some embodiments, the first fusion protein comprises a first mitoZF to bind a target nucleic acid sequence proximal (as defined herein above) to the target nucleotide. In some embodiments, the second fusion protein comprises a mitoZF to bind a target nucleic acid sequence proximal to the nucleotide complementary to the target nucleotide. In some embodiments, the first and second mitoZFs are configured to bind proximally to the same target nucleotide (or nucleotide complementary thereto, as described herein above). In some embodiments, the first and second fusion proteins comprise mitoZFs configured to bind first and second target nucleic acid sequences such that the first and second portions of DddA can dimerize (i.e., re-assemble) at or near the target nucleotide, such that re-assembled first and second portions of a DddA regain, at least partially, the native activity (e.g., deamination) of a full-length DddA. In some embodiments, the first and second fusion proteins comprise mitoTALEs configured to bind first and second target nucleic acid sequences such that that the first and second portions of a DddA can dimerize (i.e., re-assemble) at or near the target nucleotide, such that the target nucleotide is affected by activity of a re-assembled first and second portions of a DddA. Any suitable architecture of the fusion proteins comprising mitoZFs are contemplated, and shows in FIG. 1F.

In some embodiments, the first fusion protein comprises the amino acid sequence of any one of SEQ ID NOs.:

360-375. In some embodiments, the first fusion protein comprises an amino acid sequence with 75% or greater percent identity (e.g., 80% or greater, 85% or greater, 90% or greater, 95% or greater, 96% or greater, 97% or greater, 98% or greater. 99% or greater, 99.5% or greater, 99.9% or greater percent identity) any one of SEQ ID NOs.: 360-375. In some embodiments, the second fusion protein comprises the amino acid sequence of any one of SEQ ID NOs.: 360-375. In some embodiments, the second fusion protein comprises an amino acid sequence with 75% or greater percent identity (e.g., 80% or greater, 85% or greater, 90% or greater, 95% or greater, 96% or greater, 97% or greater, 98% or greater, 99% or greater, 99.5% or greater, 99.9% or greater percent identity) to any one of SEQ ID NOs.: 360-375.

In some embodiments, the first and second fusion protein form pairs which result from the targeting of a similar target nucleotide, or which first and second portion of a DddA form a pair of portions which can re-assemble (e.g., dimerize) to form a protein with, at least partially, the activity of a full-length DddA (e.g., deamination). In some embodiments, the pair of fusion proteins comprise a first fusion protein comprising the first fusion protein of any one of and a second fusion protein comprising the second fusion protein wherein the first mitoTALE of the first fusion protein is configured to bind a first nucleic acid sequence proximal to a target nucleotide and the second mitoTALE of the second fusion protein is configured to bind a second nucleic acid sequence proximal to a nucleotide opposite the target nucleotide. In some embodiments, the first nucleic acid sequence is upstream of the target nucleotide and the second nucleic acid sequence is upstream of a nucleic acid of the complementary nucleotide of the target nucleotide. In some embodiments, the re-assembly (i.e., dimerization) of the first and second fusion proteins facilitate deamination of the target nucleotide.

mtDNA BEs Comprising mitoTALES

The mtDNA base editors described herein contemplate fusion proteins comprising a mitoTALE and a DddA domain or fragment or portion thereof (e.g., an N-terminal or C-terminal fragment or portion of a DddA), and optionally the joining of the two by a linker. The application contemplates any suitable mitoTALE and a DddA domain to be combined in a single fusion protein. Examples of mitoTALEs and DddA domains are each defined herein.

In some embodiments, the mtDNA base editors comprise DddA domains which are DdCBE, i.e., DddA which deaminates a C. Examples of general architecture of mtDNA base editors comprising DdCBEs and mitoTALEs and their amino acid and nucleotide sequences are as follows:

All right-side halves of DdCBEs have the general architecture of (from N- to C-terminus): COX8A MTS-3xFLAG-mitoTALE-2aa linker-DddA$_{tox}$ half-4aa linker-1x-UGI-ATP5B 3'UTR All left-side halves of DdCBEs have the general architecture of (from N- to C-terminus): SOD2 MTS-3xHA-mitoTALE-2aa linker-DddA$_{tox}$ half-4aa linker-1x-UGI-SOD2 3'UTR (A) SOD2 MTS (SEQ ID NO: 298)

MLSRAVCGTSRQLAPVLGYLGSRQKHSLPD (B) COX8A MTS (SEQ ID NO: 299)

MSVLTPLLLRGLTGSARRLPVPRAKIHSL (C) SOD2 3'UTR (SEQ ID NO: 300)

ACCACGATCGTTATGCTGATCATACCCTAATGATCCCAGCAAGATAATGTCCTGTCT

TCTAAGATGTGCATCAAGCCTGGTACATACTGAAAACCCTATAAGGTCCTGGATAA

TTTTTGTTTGATTATTCATTGAAGAAACATTTATTTTCCAATTGTGTGAAGTTTTTGA

CTGTTAATAAAAGAATCTGTCAACCATCAAAAAAAAAAAAAAA (D) ATP5B 3'UTR (SEQ ID NO: 301)

ACCACGATCGTTATGCTGATCATACCCTAATGATCCCAGCAAGATAATGTCCTGTCT

TCTAAGATGTGCATCAAGCCTGGTACATACTGAAAACCCTATAAGGTCCTGGATAA

TTTTTGTTTGATTATTCATTGAAGAAACATTTATTTTCCAATTGTGTGAAGTTTTTGA

CTGTTAATAAAAGAATCTGTCAACCATCAAAAAAAAAAAAAAA (E) ND6-DdCBE: Left mitoTALE-G1397-DddA$_{tox}$-N-1x-UGI (SEQ ID NO: 302)

ATGGCCCTGTCCCGTGCGGTTTGTGGCACCTCCCGTCAACTGGCTCCGGTTCTGGGT

TATCTGGGTTCCCGTCAAAAACACTCCCTGCCGGACTACCCGTATGATGTTCCGGAT

TACGCTGGCTACCCATACGACGTCCCAGACTACGCTGGCTACCCATACGACGTCCC

AGACTACGCTATGGACATCGCGGATCTGCGTACCCTGGGTTACAGCCAGCAGCAGC

AGGAGAAGATCAAGCCGAAGGTGCGCAGCACCGTGGCTCAGCACCACGAAGCCCT

GGTGGGCCACGGTTTCACCCACGCTCACATTGTGGCCCTGAGCCAGCACCCAGCCG

CGCTGGGCACCGTGGCCGTGAAATATCAGGATATGATTGCTGCCCTGCCAGAGGCC

-continued

ACCCATGAAGCTATTGTGGGCGTGGGCAAGCAGTGGAGCGGTGCTCGTGCGCTGGA

GGCGCTGCTGACCGTGGCTGGTGAACTGCGTGGTCCGCCGCTGCAGCTGGACACCG

GTCAGCTGCTGAAAATCGCGAAACGTGGCGGTGTGACCGCGGTGGAAGCCGTGCAT

GCTTGGCGTAATGCTCTGACCGGTGCGCCGCTGAACCTGACCCCGCAGCAGGTGGT

GGCTATTGCCAGCAACAACGGCGGTAAACAGGCCCTGGAGACCGTGCAGCGCCTG

CTGCCGGTGCTGTGCCAGGCCCATGGTCTGACCCCGGAGCAGGTGGTGGCGATCGC

TAGCAACATCGGCGGCAAGCAGGCCCTGGAAACCGTGCAGGCGCTGTTACCGGTGC

TGTGCCAGGCTCATGGCCTGACCCCGGAACAAGTIGTGGCTATTGCCAGCCATGAT

GGCGGTAAACAGGCTCTGGAAACCGTGCAGCGTCTGTTGCCGGTGCTGTGCCAAGC

CCATGGCCTGACCCCGGAGCAAGTTGTGGCTATTGCGAGCCATGATGGCGGCAAGC

AGGCGCTGGAAACCGTTCAGCGCCTGTTACCGGTGCTGTGCCAAGCTCATGGTCTG

ACCCCGGAACAGGTGGTGGCCATTGCTTCCCATGATGGCGGTAAACAGGCCCTGGA

AACCGTTCAGCGTCTGCTTCCGGTGCTGTGCCAGGCCCATGGGCTGACCCCGGAAC

AAGTGGTTGCTATTGCCAGCCACGATGGCGGCAAGCAGGCTCTGGAGACCGTTCAG

CGCCTGCTTCCGGTGCTGTGCCAGGCCCATGGCTTAACCCCGGAACAAGTTGTTGCT

ATTGCTAGTCATGATGGCGGTAAACAGGCGCTGGAGACCGTTCAGCGTCTGTTACC

GGTGCTGTGCCAGGCGCATGGCTTAACCCCGGAGCAGGTTGTTGCCATTGCCTCCA

ATATCGGCGGCAAGCAGGCTCTGGAAACCGTTCAGGCCCTGTTGCCGGTGCTGTGC

CAGGCCCATGGACTGACCCCGCAGCAAGTTGTTGCCATTGCCAGCAATGGCGGTGG

CAAACAGGCGCTGGAAACTGTTCAGCGCCTGCTCCCGGTGCTGTGCCAAGCGCATG

GTCTGACCCCGCAGCAAGTGGTTGCTATTGCTAGCAATGGTGGCGGTCGTCCGGCG

CTGGAAAGCATTGTGGCTCAGCTGAGCCGTCCAGACCCGGCCCTGGCGGCTCTGAC

CAACGATCACCTGGTGGCGCTGGCTTGCCTGGGCGGTCGTCCGGCCCTGGATGCGG

TGAAGAAAGGCCTGGGTGGATCCGGCAGCTACGCCCTGGGTCCGTATCAGATTAGC

GCCCCGCAGCTGCCAGCTTACAATGGTCAGACCGTGGGTACCTTCTACTATGTGAA

CGACGCGGGCGGTCTGGAGAGCAAGGTGTTTAGCAGCGGCGGTCCAACCCCGTACC

CAAACTATGCCAATGCCGGTCATGTGGAGGGTCAGAGCGCCCTGTTCATGCGTGAT

AACGGCATCAGCGAGGGTCTGGTGTTCCACAACAACCCGGAAGGCACCTGCGGTTT

TTGCGTGAACATGACCGAGACCCTGCTGCCGGAAAACGCGAAAATGACCGTGGTGC

CGCCGGAAGGTTCTGGCGGCTCAACTAATCTGAGCGACATCATTGAGAAGGAGACT

GGGAAACAGCTGGTCATTCAGGAGTCCATCCTGATGCTGCCTGAGGAGGTGGAGGA

AGTGATCGGCAACAAGCCAGAGTCTGACATCCTGGTGCACACCGCCTACGACGAGT

CCACAGATGAGAATGTGATGCTGCTGACCTCTGACGCCCCCGAGTATAAGCCTTGG

GCCCTGGTCATCCAGGATTCTAACGGCGAGAATAAGATCAAGATGCTGTGATAAAC

CACGATCGTTATGCTGATCATACCCTAATGATCCCAGCAAGATAATGTCCTGTCTTC

TAAGATGTGCATCAAGCCTGGTACATACTGAAAACCCTATAAGGTCCTGGATAATT

TTTGTTTGATTATTCATTGAAGAAACATTTATTTTCCAATTGTGTGAAGTTTTTGACT

GTTAATAAAAGAATCTGTCAACCATCAAA (F) ND6-DdCBE: Right mitoTALE-G1397-DddA$_{tox}$-N-1x-UGI
(SEQ ID NO: 303)

TCCGTTCTGACCCCGCTGCTGCTGCGTGGCCTGACCGGCTCCGCTCGTCGTCTGCCA

GTTCCGCGTGCGAAAATCCATTCCCTGGACTACAAAGACCATGACGGTGATTATAA

-continued

AGATCATGACATCGATTACAAGGATGACGATGACAAGATGGACATCGCGGATCTGC

GTACCCTGGGTTACAGCCAGCAGCAGCAGGAGAAGATCAAGCCAAAGGTGCGCAG

CACCGTGGCCCAGCACCATGAAGCTCTGGTGGGTCACGGCTTCACCCACGCGCACA

TCGTGGCTCTGAGCCAGCACCCAGCCGCGCTGGGTACCGTGGCCGTGAAATATCAG

GACATGATTGCTGCCCTGCCAGAGGCTACCCATGAAGCGATTGTGGGTGTGGGCAA

GAGAGGAGCCGGTGCTCGTGCGCTGGAGGCCCTGCTGACCGTGGCCGGTGAACTGC

GTGGCCCGCCGCTGCAGCTGGATACCGGCCAGCTGCTGAAAATCGCGAAACGTGGC

GGTGTGACCGCTGTGGAAGCTGTGCATGCCTGGCGTAATGCTCTGACCGGTGCCCC

GCTGAACCTGACCCCGCAGCAGGTGGTGGCTATTGCCAGCAACAACGGCGGTAAAC

AGGCTCTGGAAACCGTGCAGCGCCTGCTGCCGGTGCTGTGCCAGGCTCATGGTCTG

ACCCCGGAGCAGGTGGTGGCGATCGCTAGCAACATCGGCGGCAAGCAGGCTCTGG

AGACCGTTCAGGCCCTGTTACCGGTGCTGTGCCAAGCCCATGGTCTGACCCCGCAG

CAAGTTGTGGCTATTGCCAGCAATGGCGGTGGCAAACAGGCGCTGGAGACCGTGCA

GCGTCTGTTGCCGGTGCTGTGCCAAGCCCATGGGCTGACCCCGCAGCAAGTGGTTG

CCATCGCCAGCAACAACGGTGGCAAGCAGGCCCTGGAGACCGTTCAGCGCCTGTTA

CCGGTGCTGTGCCAGGCCCATGGCTTAACCCCGCAGCAAGTTGTGGCCATCGCTAG

CAACAACGGTGGCAAACAGGCTCTGGAGACTGTTCAGCGTCTGCTTCCGGTGCTGT

GCCAAGCGCATGGCCTGACCCCGGAACAAGTTGTTGCTATTGCCAGCCATGATGGT

GGCAAGCAGGCGCTGGAAACCGTTCAGCGCCTGCTTCCGGTGCTGTGCCAGGCGCA

TGGATTAACCCCGCAGCAAGTGGTGGCCATCGCCAGCAATGGTGGCGGTAAACAG

GCCCTGGAAACCGTTCAGCGTCTGTTACCGGTGCTGTGCCAGGCCCATGGATTAAC

CCCGGAACAAGTIGTGGCTATTGCGTCCAATATCGGCGGCAAGCAGGCGCTGGAAA

CTGTGCAGGCTCTGCTCCCGGTGCTGTGCCAGGCCCATGGGTTAACCCCGCAGCAG

GTTGTTGCCATTGCGAGCAACGGCGGTGGCAAACAGGCTCTGGAGACGGTTCAGCG

CCTGCTCCCGGTGCTGTGCCAGGCCCATGGTTTAACCCCGCAGCAGGTGGTTGCTAT

TGCTAGCAATGGCGGCGGCAAGCAGGCGCTGGAAACGGTGCAGCGTCTGCTACCG

GTGCTGTGCCAGGCACATGGCCTTACCCCGCAGCAAGTTGTGGCCATTGCTAGCAA

TGGCGGTGGCCGTCCGGCCCTGGAAAGCATTGTGGCGCAGCTGAGCCGTCCAGACC

CGGCCCTGGCGGCTCTGACCAATGATCACCTGGTGGCCCTGGCCTGCCTGGGTGGC

CGTCCGGCTCTGGATGCCGTGAAGAAAGGTCTGGGCGGATCCGCCATTCCAGTGAA

GCGCGGCGCTACCGGTGAAACCAAAGTGTTTACCGGTAACAGCAACAGCCCGAAG

AGCCCGACCAAAGGCGGTTGCTCTGGCGGCTCAACTAATCTGAGCGACATCATTGA

GAAGGAGACTGGGAAACAGCTGGTCATTCAGGAGTCCATCCTGATGCTGCCTGAGG

AGGTGGAGGAAGTGATCGGCAACAAGCCAGAGTCTGACATCCTGGTGCACACCGC

CTACGACGAGTCCACAGATGAGAATGTGATGCTGCTGACCTCTGACGCCCCCGAGT

ATAAGCCTTGGGCCCTGGTCATCCAGGATTCTAACGGCGAGAATAAGATCAAGATG

CTGTGATAAGGGGTCTTTGTCCTCTGTACTGTCTCTCTCCTTGCCCCTAACCCAAAA

AGCTTCATTTTTCTGTGTAGGCTGCACAAGAGCCTTGATTGAAGATATATTCTTTCT

GAACAGTATTTAAGGTTTCCAATAAAATGTACACCCCTCAGAA

-continued (G) ND1-DdCBE Right mitoTALE repeat (SEQ ID NO: 304)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCGGAACAGGTGGTTGCCATCGCATC

CAATAATGGTGGTAAACAAGCTCTGGAGACCGTTCAAGCCCTGCTGCCAGTGCTGT

GCCAGGCTCATGGTCTGACCCCGCAGCAAGTTGTGGCTATTGCCAGCAACATCGGC

GGCAAGCAGGCCCTGGAGACCGTGCAGCGTCTGCTGCCGGTGCTGTGCCAGGCCCA

TGGCCTGACCCCGCAGCAAGTGGTTGCTATCGCCAGCAACAACGGCGGTAAACAGG

CTCTGGAAACCGTGCAGCGCCTGTTACCGGTGCTGTGCCAAGCCCATGGTCTGACC

CCGGAGCAGGTGGTGGCGATTGCTAGCAACGGCGGTGGCAAGCAGGCTCTGGAGA

CCGTTCAGGCCCTGCTTCCGGTGCTGTGCCAAGCGCATGGCCTGACCCCGGAACAA

GTTGTTGCCATTGCCAGCAATGGTGGCGGTAAACAGGCGCTGGAAACCGTGCAGGC

TCTGTTACCGGTGCTGTGCCAGGCCCATGGGCTGACCCCGGAGCAAGTGGTGGCTA

TTGCGAGCAATGGCGGTGGCAAGCAGGCCCTGGAAACCGTGCAGGCGCTGTTGCCG

GTGCTGTGCCAAGCCCATGGATTAACCCCGGAACAAGTGGTGGCGATCGCTAGCAA

CAACGGTGGCAAACAGGCGCTGGAGACCGTTCAGCGTCTGTTACCGGTGCTGTGCC

AGGCGCATGGCTTAACCCCGGAACAGGTTGTTGCGATTGCCAGCAACATTGGTGGC

AAGCAGGCTCTGGAAACCGTTCAGGCCCTGCTCCCGGTGCTGTGCCAGGCCCATGG

TTTAACCCCGGAACAGGTGGTGGCCATTGCCAGCAACGGTGGCGGTAAACAGGCCC

TGGAGACCGTTCAGCGCCTGCTACCGGTGCTGTGCCAGGCCCATGGACTGACCCCG

GAGCAAGTTGTTGCCATTGCTAGCAACAACGGCGGCAAGCAGGCGCTGGAGACCG

TGCAGGCTCTGCTTCCGGTGCTGTGCCAGGCCCATGGGTTAACCCCGGAGCAGGTT

GTGGCCATCGCCAGCCACGACGGCGGTAAACAGGCCCTGGAAACCGTTCAGGCGCT

GCTACCGGTGCTGTGCCAGGCACATGGCTTAACCCCGGAGCAGGTGGTTGCCATCG

CCTCCAATGGCGGTGGCAAGCAGGCTCTGGAAACGGTGCAGGCCCTGCTGCCGGTG

CTGTGCCAAGCCCATGGGTTGACCCCGGAACAAGTGGTGGCTATTGCTAGCCACGA

CGGTGGCAAACAGGCTCTGGAGACTGTTCAGCGTCTGCTTCCGGTGCTGTGCCAGG

CTCATGGCTTAACCCCGCAGCAAGTTGTTGCTATTGCCTCCAATATTGGTGGCAAGC

AGGCGCTGGAAACCGTTCAGCGCCTGCTGCCGGTGCTGTGCCAGGCTCATGGGCTT

ACCCCGGAACAAGTTGTGGCCATTGCCTCCCATGATGGTGGCAAACAGGCGCTGGA

AACTGTGCAGGCTCTGCTCCCGGTGCTGTGCCAGGCTCATGGATTAACCCCGCAGC

AAGTGGTGGCCATTGCTAGCCACGATGGTGGCAAGCAGGCCCTGGAGACGGTTCAG

CGTCTGCTCCCGGTGCTGTGCCAGGCCCATGGGCTAACCCCGCAGCAGGTTGTTGCT

ATTGCCAGTCATGATGGTGGCAAACAGGCTCTGGAAACTGTGCAGCGCCTGCTACC

GGTGCTGTGCCAGGCTCACGGTCTGACCCCGCAGCAGGTGGTGGCAATCGCAAGCA

-continued

ACGGTGGTGGTCGTCCGGCACTGGAAAGCATTGTGGCGCAGCTGAGCCGTCCAGAC

CCGGCCCTGGCGGCTCTGACCAATGATCACCTGGTGGCCCTGGCCTGCCTGGGTGG

CCGTCCGGCTCTGGATGCCGTGAAGAAAGGTCTGGGC

Translated Amino Acid Sequence:

(SEQ ID NO: 305)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASNNGGKQALETVQALLPVLCQAHGL

TPQQVVAIASNIGGKQALETVQRLLPVLCQAHGLTPQQVVAIASNNGGKQALETVQRL

LPVLCQAHGLTPEQVVAIASNGGGKQALETVQALLPVLCQAHGLTPEQVVAIASNGGG

KQALETVQALLPVLCQAHGLTPEQVVAIASNGGGKQALETVQALLPVLCQAHGLTPEQ

VVAIASNNGGKQALETVQRLLPVLCQAHGLTPEQVVAIASNIGGKQALETVQALLPVL

CQAHGLTPEQVVAIASNGGGKQALETVQRLLPVLCQAHGLTPEQVVAIASNNGGKQA

LETVQALLPVLCQAHGLTPEQVVAIASHDGGKQALETVQALLPVLCQAHGLTPEQVVA

IASNGGGKQALETVQALLPVLCQAHGLTPEQVVAIASHDGGKQALETVQRLLPVLCQA

HGLTPQQVVAIASNIGGKQALETVQRLLPVLCQAHGLTPEQVVAIASHDGGKQALETV

QALLPVLCQAHGLTPQQVVAIASHDGGKQALETVQRLLPVLCQAHGLTPQQVVAIASH

DGGKQALETVQRLLPVLCQAHGLTPQQVVAIASNGGGRPALESIVAQLSRPDPALAAL

TNDHLVALACLGGRPALDAVKKGLG (H) ND1-DdCBE Left mitoTALE repeat (SEQ ID NO: 306)

GACATCGCGGATCTGCGTACCCTGGGTTACAGCCAGCAGCAGCAGGAGAAGATCA

AGCCGAAGGTGCGCAGCACCGTGGCTCAGCACCACGAAGCCCTGGTGGGCCACGG

TTTCACCCACGCTCACATTGTGGCCCTGAGCCAGCACCCAGCCGCGCTGGGCACCG

TGGCCGTGAAATATCAGGATATGATTGCTGCCCTGCCAGAGGCCACCCATGAAGCT

ATTGTGGGCGTGGGCAAGCAGTGGAGCGGTGCTCGTGCGCTGGAGGCGCTGCTGAC

CGTGGCTGGTGAACTGCGTGGTCCGCCGCTGCAGCTGGACACCGGTCAGCTGCTGA

AAATCGCGAAACGTGGCGGTGTGACCGCGGTGGAAGCCGTGCATGCTTGGCGTAAT

GCTCTGACCGGTGCGCCGCTGAACCTGACCCCGGAACAAGTGGTTGCTATCGCATC

CCATGACGGCGGTAAACAAGCCCTGGAGACCGTTCAAGCCCTGCTGCCAGTGCTGT

GCCAGGCTCATGGTCTGACCCCGCAGCAGGTGGTGGCTATTGCCAGCAATGGCGGT

GGCAAGCAGGCGCTGGAGACCGTGCAGCGTCTGCTGCCGGTGCTGTGCCAAGCCCA

TGGCCTGACCCCGCAGCAAGTTGTGGCTATCGCCAGCAACATTGGTGGCAAACAGG

CCCTGGAAACCGTGCAGCGCCTGTTACCGGTGCTGTGCCAGGCCCATGGTCTGACC

CCGGAGCAGGTGGTGGCGATCGCTAGCAACAACGGTGGCAAGCAGGCTCTGGAAA

CCGTGCAGGCCCTGCTTCCGGTGCTGTGCCAGGCCCATGGGCTGACCCCGGAACAA

GTTGTGGCTATTGCCAGCCACGACGGTGGCAAACAGGCGCTGGAAACCGTGCAGGC

TCTGTTACCGGTGCTGTGCCAAGCGCATGGCCTGACCCCGGAACAGGTGGTGGCTA

TTGCTAGCCACGATGGTGGCAAGCAGGCCCTGGAGACCGTTCAGGCGCTGTTGCCG

GTGCTGTGCCAGGCGCATGGCTTAACCCCGGAACAAGTTGTTGCGATTGCTAGCAA

CGGTGGCGGTAAACAGGCTCTGGAGACCGTTCAGCGTCTGTTACCGGTGCTGTGCC

-continued

AGGCACATGGCCTGACCCCGGAGCAAGTTGTTGCCATTGCCAGCAACATCGGCGGC

AAGCAGGCTCTGGAGACCGTGCAGGCCCTGCTCCCGGTGCTGTGCCAGGCCCATGG

CTTAACCCCGGAGCAAGTTGTGGCCATTGCCAGCAACAACGGCGGTAAACAGGCGC

TGGAGACCGTTCAGCGCCTGCTACCGGTGCTGTGCCAGGCTCATGGCTTGACCCCG

GAACAGGTTGTTGCGATTGCGAGCCATGATGGCGGCAAGCAGGCGCTGGAAACCG

TTCAGGCTCTGCTTCCGGTGCTGTGCCAGGCCCATGGATTAACCCCGGAGCAGGTT

GTTGCTATTGCCAGCCATGATGGCGGTAAACAGGCCCTGGAGACCGTGCAGGCGCT

GCTACCGGTGCTGTGCCAGGCTCATGGGCTGACCCCGGAGCAAGTGGTTGCTATCG

CGAGCAACAATGGCGGCAAGCAGGCTCTGGAAACGGTGCAGGCCCTGCTGCCGGT

GCTGTGCCAGGCCCATGGGTTAACCCCGGAACAAGTGGTGGCCATCGCTAGCAACG

GCGGTGGCAAACAGGCCCTGGAGACTGTTCAGCGTCTGCTTCCGGTGCTGTGCCAG

GCCCATGGGCTAACCCCGCAGCAAGTGGTTGCCATTGCCAGCAATGGCGGCGGCAA

GCAGGCTCTGGAAACTGTGCAGCGCCTGCTGCCGGTGCTGTGCCAGGCTCACGGTC

TGACCCCGCAACAGGTGGTGGCAATCGCAAGCAATGGTGGTGGTCGTCCGGCACTG

GAGAGCATTGTGGCTCAGCTGAGCCGTCCAGACCCGGCCCTGGCGGCTCTGACCAA

CGATCACCTGGTGGCGCTGGCTTGCCTGGGCGGTCGTCCGGCCCTGGATGCGGTGA

AGAAAGGCCTGGGT

Translated Amino Acid Sequence:

(SEQ ID NO: 307)
DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASHDGGKQALETVQALLPVLCQAHGL

TPQQVVAIASNGGGKQALETVQRLLPVLCQAHGLTPQQVVAIASNIGGKQALETVQRL

LPVLCQAHGLTPEQVVAIASNNGGKQALETVQALLPVLCQAHGLTPEQVVAIASHDGG

KQALETVQALLPVLCQAHGLTPEQVVAIASHDGGKQALETVQALLPVLCQAHGLTPEQ

VVAIASNGGGKQALETVQRLLPVLCQAHGLTPEQVVAIASNIGGKQALETVQALLPVL

CQAHGLTPEQVVAIASNNGGKQALETVQRLLPVLCQAHGLTPEQVVAIASHDGGKQA

LETVQALLPVLCQAHGLTPEQVVAIASHDGGKQALETVQALLPVLCQAHGLTPEQVVA

IASNNGGKQALETVQALLPVLCQAHGLTPEQVVAIASNGGGKQALETVQRLLPVLCQA

HGLTPQQVVAIASNGGGKQALETVQRLLPVLCQAHGLTPQQVVAIASNGGGRPALESI

VAQLSRPDPALAALTNDHLVALACLGGRPALDAVKKGLG (I) ND2-DdCBE Right mitoTALE repeat (SEQ ID NO: 308)
GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCGGAACAAGTGGTTGCCATCGCATC

-continued

CAATATCGGTGGTAAACAAGCCCTGGAGACCGTTCAAGCCCTGCTGCCAGTGCTGT
GCCAGGCTCATGGTCTGACCCCGCAGCAGGTGGTGGCCATTGCGAGCAACAATGGC
GGCAAGCAGGCGCTGGAGACCGTGCAGCGTCTGCTGCCGGTGCTGTGCCAAGCCCA
TGGCCTGACCCCGCAGCAAGTGGTTGCTATCGCCAGCAACATTGGCGGTAAACAGG
CCCTGGAAACCGTGCAGCGCCTGTTACCGGTGCTGTGCCAGGCCCATGGTCTGACC
CCGGAGCAGGTGGTGGCGATCGCTAGCAACATCGGCGGCAAGCAGGCTCTGGAAA
CCGTGCAGGCCCTGCTTCCGGTGCTGTGCCAGGCCCATGGGCTGACCCCGGAACAA
GTTGTGGCTATTGCCAGCCATGATGGCGGTAAACAGGCGCTGGAAACCGTGCAGGC
TCTGTTACCGGTGCTGTGCCAAGCGCATGGCCTGACCCCGGAACAGGTGGTGGCTA
TTGCGAGCAATGGCGGTGGCAAGCAGGCCCTGGAGACCGTTCAGGCGCTGTTGCCG
GTGCTGTGCCAGGCGCATGGCTTAACCCCGGAACAAGTTGTTGCGATCGCTAGCAA
CAACGGTGGCAAACAGGCTCTGGAGACCGTTCAGCGTCTGTTACCGGTGCTGTGCC
AGGCACATGGCCTGACCCCGGAGCAAGTTGTTGCCATTGCCAGCCACGATGGTGGC
AAGCAGGCTCTGGAGACCGTGCAGGCCCTGCTCCCGGTGCTGTGCCAGGCCCATGG
CTTAACCCCGGAGCAAGTTGTGGCTATCGCCAGCAACGGTGGCGGTAAACAGGCGC
TGGAGACCGTTCAGCGCCTGCTACCGGTGCTGTGCCAGGCTCATGGCTTGACCCCG
GAACAGGTTGTTGCCATTGCGTCCAATATCGGCGGCAAGCAGGCGCTGGAAACCGT
TCAGGCTCTGCTTCCGGTGCTGTGCCAGGCCCATGGATTAACCCCGGAGCAGGTTG
TGGCGATTGCGAGCAACGGCGGTGGCAAACAGGCCCTGGAGACCGTGCAGGCGCT
GCTACCGGTGCTGTGCCAGGCTCATGGGCTGACCCCGGAGCAAGTGGTTGCTATTG
CTAGCAATGGCGGCGGCAAGCAGGCTCTGGAAACGGTGCAGGCCCTGCTGCCGGT
GCTGTGCCAGGCCCATGGGTTAACCCCGGAACAAGTGGTGGCCATCGCTTCCAATA
TTGGCGGTAAACAGGCCCTGGAGACTGTTCAGCGTCTGCTTCCGGTGCTGTGCCAG
GCCCATGGGCTAACCCCGCAGCAAGTTGTTGCTATTGCCTCCAATGGCGGTGGCAA
GCAGGCTCTGGAAACTGTGCAGCGCCTGCTGCCGGTGCTGTGCCAGGCTCACGGCC
TGACCCCGCAGCAAGTTGTGGCAATCGCAAGCAATGGTGGTGGTCGTCCGGCTCTG
GAGAGCATTGTGGCGCAGCTGAGCCGTCCAGACCCGGCCCTGGCGGCTCTGACCAA
TGATCACCTGGTGGCCCTGGCCTGCCTGGGTGGCCGTCCGGCTCTGGATGCCGTGA
AGAAAGGTCTGGGC

Translated Amino Acid Sequence:

(SEQ ID NO: 309)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNIGGKQALETVQALLPVLCQAHGL
TPQQVVAIASNNGGKQALETVQRLLPVLCQAHGLTPQQVVAIASNIGGKQALETVQRL
LPVLCQAHGLTPEQVVAIASNIGGKQALETVQALLPVLCQAHGLTPEQVVAIASHDGG
KQALETVQALLPVLCQAHGLTPEQVVAIASNGGGKQALETVQALLPVLCQAHGLTPEQ
VVAIASNNGGKQALETVQRLLPVLCQAHGLTPEQVVAIASHDGGKQALETVQALLPVL
CQAHGLTPEQVVAIASNGGGKQALETVQRLLPVLCQAHGLTPEQVVAIASNIGGKQAL
ETVQALLPVLCQAHGLTPEQVVAIASNGGGKQALETVQALLPVLCQAHGLTPEQVVAI

-continued

ASNGGGKQALETVQALLPVLCQAHGLTPEQVVAIASNIGGKQALETVQRLLPVLCQAH

GLTPQQVVAIASNGGGKQALETVQRLLPVLCQAHGLTPQQVVAIASNGGGRPALESIV

AQLSRPDPALAALTNDHLVALACLGGRPALDAVKKGLG (J) ND2-DdCBE Left mitoTALE repeat (SEQ ID NO: 310)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCGGAACAAGTGGTGGCTATCGCGTC

CCATGATGGTGGTAAACAGGCTCTGGAGACCGTGCAAGCTCTGCTGCCAGTGCTGT

GCCAGGCCCATGGTCTGACCCCGCAGCAGGTGGTGGCTATTGCCAGCAATGGCGGT

GGCAAGCAGGCGCTGGAGACCGTGCAGCGTCTGCTGCCGGTGCTGTGCCAGGCTCA

TGGCCTGACCCCGCAGCAAGTTGTGGCTATTGCCAGCAACGGTGGCGGTAAACAGG

CCCTGGAGACCGTGCAGCGCCTGTTACCGGTGCTGTGCCAAGCCCATGGCCTGACC

CCGGAGCAGGTGGTGGCGATCGCTAGCAACATCGGCGGCAAGCAGGCTCTGGAAA

CCGTGCAGGCCCTGCTTCCGGTGCTGTGCCAGGCCCATGGCTTAACCCCGGAACAG

GTTGTTGCTATTGCCAGCAACAACGGCGGTAAACAGGCGCTGGAAACCGTGCAGGC

TCTGTTACCGGTGCTGTGCCAGGCCCATGGGCTGACCCCGGAACAAGTTGTGGCTA

TTGCGAGCCATGATGGCGGCAAGCAGGCCCTGGAAACCGTGCAGGCGCTGTTGCCG

GTGCTGTGCCAAGCCCATGGATTAACCCCGGAACAAGTTGTTGCGATCGCTAGCAA

CATTGGCGGTAAACAGGCTCTGGAAACCGTTCAGCGTCTGTTACCGGTGCTGTGCC

AGGCGCATGGTCTGACCCCGGAACAGGTTGTGGCCATTGCCTCCAATGGCGGTGGC

AAGCAGGCTCTGGAGACCGTTCAGGCCCTGCTCCCGGTGCTGTGCCAAGCGCATGG

CCTGACCCCGGAACAGGTGGTGGCTATCGCCAGCAACATTGGTGGCAAACAGGCGC

TGGAGACCGTTCAGCGCCTGCTACCGGTGCTGTGCCAGGCACATGGTCTGACCCCG

GAGCAAGTTGTGGCCATTGCTAGCCACGATGGTGGCAAGCAGGCGCTGGAAACCGT

TCAGGCTCTGCTTCCGGTGCTGTGCCAGGCCCATGGTTTAACCCCGGAACAAGTGG

TTGCCATTGCGTCCAATGGTGGCGGTAAACAGGCCCTGGAAACCGTTCAGGCGCTG

CTACCGGTGCTGTGCCAGGCTCATGGGCTGACCCCGGAGCAAGTGGTTGCTATTGC

TTCCCATGATGGCGGCAAGCAGGCTCTGGAAACGGTGCAGGCCCTGCTGCCGGTGC

TGTGCCAAGCCCATGGGTTAACCCCGGAACAGGTGGTTGCGATTGCTAGCCACGAC

GGCGGTAAACAGGCCCTGGAAACGGTTCAGCGTCTGCTTCCGGTGCTGTGCCAGGC

CCATGGACTTACCCCGCAGCAGGTTGTGGCGATTGCCTCCAATGGCGGTGGCAAGC

AGGCTCTGGAAACTGTGCAGCGCCTGCTGCCGGTGCTGTGCCAGGCTCATGGTTTA

ACCCCGGAGCAGGTTGTTGCCATCGCCAGCCACGACGGTGGCAAACAGGCGCTGG

AAACTGTGCAGGCTCTGCTCCCGGTGCTGTGCCAGGCTCATGGACTTACCCCGGAG

CAGGTGGTTGCCATTGCTAGCAACATTGGTGGCAAGCAGGCCCTGGAGACTGTTCA

GGCGCTGTTACCGGTGCTGTGCCAGGCCCATGGGTTAACCCCGGAGCAAGTTGTTG

-continued

CCATTGCCTCCAATATTGGTGGCAAACAGGCTCTGGAGACTGTTCAGGCCCTGCTG

CCGGTGCTGTGCCAGGCTCACGGTCTGACCCCGCAGCAAGTGGTGGCAATCGCAAG

CAATGGTGGTGGTCGTCCGGCTCTGGAGAGCATTGTGGCGCAGCTGAGCCGTCCAG

ACCCGGCCCTGGCGGCTCTGACCAATGATCACCTGGTGGCCCTGGCCTGCCTGGGT

GGCCGTCCGGCTCTGGATGCCGTGAAGAAAGGTCTGGGC

Translated Amino Acid Sequence:

(SEQ ID NO: 311)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASNIGGKQALETVQALLPVLCQAHGL

TPQQVVAIASNNGGKQALETVQRLLPVLCQAHGLTPQQVVAIASNIGGKQALETVQRL

LPVLCQAHGLTPEQVVAIASNIGGKQALETVQALLPVLCQAHGLTPEQVVAIASHDGG

KQALETVQALLPVLCQAHGLTPEQVVAIASNGGGKQALETVQALLPVLCQAHGLTPEQ

VVAIASNNGGKQALETVQRLLPVLCQAHGLTPEQVVAIASHDGGKQALETVQALLPVL

CQAHGLTPEQVVAIASNGGGKQALETVQRLLPVLCQAHGLTPEQVVAIASNIGGKQAL

ETVQALLPVLCQAHGLTPEQVVAIASNGGGKQALETVQALLPVLCQAHGLTPEQVVAI

ASNGGGKQALETVQALLPVLCQAHGLTPEQVVAIASNIGGKQALETVQRLLPVLCQAH

GLTPQQVVAIASNGGGKQALETVQRLLPVLCQAHGLTPQQVVAIASNGGGRPALESIV

AQLSRPDPALAALTNDHLVALACLGGRPALDAVKKGLG (K) ND4-DdCBE Right mitoTALE repeat (SEQ ID NO: 312)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCGGAACAAGTGGTTGCGATTGCGTC

CCATGATGGTGGTAAACAAGCCCTGGAGACCGTTCAAGCTCTGCTGCCAGTGCTGT

GCCAGGCTCATGGTCTGACCCCGCAGCAGGTGGTGGCTATTGCCAGCCATGATGGC

GGCAAGCAGGCTCTGGAGACCGTGCAGCGTCTGCTGCCGGTGCTGTGCCAAGCCCA

TGGCCTGACCCCGCAGCAAGTTGTGGCTATTGCCAGCAACGGCGGTGGCAAACAGG

CGCTGGAAACCGTGCAGCGCCTGTTACCGGTGCTGTGCCAAGCGCATGGTCTGACC

CCGGAGCAGGTGGTGGCCATCGCTAGCAACAACGGTGGCAAGCAGGCCCTGGAAA

CCGTGCAGGCGCTGTTGCCGGTGCTGTGCCAGGCCCATGGCTTAACCCCGGAACAA

GTGGTGGCCATTGCGAGCAATGGTGGCGGTAAACAGGCTCTGGAAACCGTGCAGG

CCCTGCTTCCGGTGCTGTGCCAGGCCCATGGGCTGACCCCGGAACAAGTTGTGGCT

ATCGCCAGCAACATCGGCGGCAAGCAGGCGCTGGAGACCGTTCAGGCTCTGTTACC

GGTGCTGTGCCAGGCGCATGGCCTGACCCCGGAACAGGTGGTGGCGATCGCTAGCA

ACATTGGCGGTAAACAGGCCCTGGAGACCGTTCAGCGCCTGCTCCCGGTGCTGTGC

-continued

CAGGCCCATGGTCTGACCCCGGAACAGGTTGTTGCTATTGCCAGCAACAACGGCGG

CAAGCAGGCCCTGGAGACCGTGCAGGCGCTGCTACCGGTGCTGTGCCAGGCCCATG

GACTGACCCCGGAGCAGGTTGTGGCCATCGCGTCCAATGGCGGTGGCAAACAGGCT

CTGGAGACCGTTCAGCGTCTGTTACCGGTGCTGTGCCAGGCACATGGCCTGACCCC

GGAGCAAGTTGTTGCCATCGCTAGCAACATTGGTGGCAAGCAGGCGCTGGAAACCG

TTCAGCGCCTGCTACCGGTGCTGTGCCAGGCTCATGGCTTAACCCCGGAGCAGGTT

GTCGCCATTGCCAGCAACAATGGTGGCAAACAGGCTCTGGAAACTGTGCAGGCCCT

GCTACCGGTGCTGTGCCAGGCCCATGGGTTAACCCCGGAACAGGTTGTGGCCATTG

CCTCCAATAACGGTGGCAAGCAGGCGCTGGAAACGGTGCAGGCTCTGCTTCCGGTG

CTGTGCCAGGCTCATGGGCTGACCCCGGAGCAAGTGGTTGCTATTGCGTCCAACAT

TGGTGGCAAACAGGCCCTGGAAACCGTTCAGGCGCTGCTCCCGGTGCTGTGCCAGG

CCCATGGGCTAACCCCGGAACAGGTGGTTGCCATTGCCTCCAACAATGGTGGCAAG

CAGGCCCTGGAAACGGTTCAGCGTCTGCTTCCGGTGCTGTGCCAGGCCCATGGGCT

TACCCCGCAGCAAGTTGTTGCTATCGCCAGCAATATTGGTGGCAAACAGGCTCTGG

AAACGGTGCAGCGCCTGCTACCGGTGCTGTGCCAGGCTCATGGTTTAACCCCGCAG

CAGGTGGTTGCGATTGCCTCCAACAACGGTGGCAAGCAGGCGCTGGAAACTGTTCA

GCGTCTGCTCCCGGTGCTGTGCCAGGCTCACGGCCTGACCCCGCAGCAAGTGGTGG

CTATCGCCTCCAACGGTGGTGGTCGCCCGGCTCTGGAAAGCATTGTGGCGCAGCTG

AGCCGTCCAGACCCGGCCCTGGCGGCTCTGACCAATGATCACCTGGTGGCCCTGGC

CTGCCTGGGTGGCCGTCCGGCTCTGGATGCCGTGAAGAAAGGTCTGGGC

Translated Amino Acid Sequence:

(SEQ ID NO: 313)
DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASHDGGKQALETVQALLPVLCQAHGL

TPQQVVAIASHDGGKQALETVQRLLPVLCQAHGLTPQQVVAIASNGGGKQALETVQR

LLPVLCQAHGLTPEQVVAIASNNGGKQALETVQALLPVLCQAHGLTPEQVVAIASNGG

GKQALETVQALLPVLCQAHGLTPEQVVAIASNIGGKQALETVQALLPVLCQAHGLTPE

QVVAIASNIGGKQALETVQRLLPVLCQAHGLTPEQVVAIASNNGGKQALETVQALLPV

LCQAHGLTPEQVVAIASNGGGKQALETVQRLLPVLCQAHGLTPEQVVAIASNIGGKQA

LETVQRLLPVLCQAHGLTPEQVVAIASNNGGKQALETVQALLPVLCQAHGLTPEQVVA

IASNNGGKQALETVQALLPVLCQAHGLTPEQVVAIASNIGGKQALETVQALLPVLCQA

HGLTPEQVVAIASNNGGKQALETVQRLLPVLCQAHGLTPQQVVAIASNIGGKQALETV

QRLLPVLCQAHGLTPQQVVAIASNNGGKQALETVQRLLPVLCQAHGLTPQQVVAIASN

GGGRPALESIVAQLSRPDPALAALTNDHLVALACLGGRPALDAVKKGLG (L) ND4-DdCBE Left mitoTALE repeat (SEQ ID NO: 314)
GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

-continued

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCGGAACAGGTGGTGGCAATCGCAAG

CAATAATGGTGGTAAACAGGCTCTGGAAACCGTGCAAGCTCTGCTGCCAGTTCTGT

GCCAGGCTCATGGTCTGACCCCGCAGCAGGTGGTGGCTATTGCCAGCCATGATGGC

GGCAAGCAGGCCCTGGAGACCGTGCAGCGTCTGCTGCCGGTGCTGTGCCAGGCCCA

TGGCCTGACCCCGCAGCAAGTIGTGGCTATTGCCAGCAACGGCGGTGGCAAACAGG

CTCTGGAGACCGTGCAGCGCCTGTTACCGGTGCTGTGCCAAGCCCATGGTCTGACC

CCGGAGCAGGTGGTGGCGATCGCTAGCAACATTGGTGGCAAGCAGGCCCTGGAAA

CCGTGCAGGCGCTGTTGCCGGTGCTGTGCCAAGCCCATGGGCTGACCCCGGAACAA

GTTGTTGCCATTGCCAGCAACAATGGTGGCAAACAGGCTCTGGAAACTGTGCAGGC

CCTGCTTCCGGTGCTGTGCCAGGCCCATGGATTAACCCCGGAACAAGTTGTGGCTA

TTGCGAGCAATGGCGGCGGCAAGCAGGCGCTGGAAACCGTGCAGGCTCTGTTACCG

GTGCTGTGCCAGGCGCATGGCCTGACCCCGGAGCAAGTGGTGGCCATCGCTAGCAA

CATTGGCGGTAAACAGGCGCTGGAGACCGTTCAGCGTCTGTTACCGGTGCTGTGCC

AGGCACATGGCCTTACCCCGGAACAAGTTGTGGCCATTGCCAGCAACATCGGCGGC

AAGCAGGCCCTGGAAACGGTGCAGGCGCTGCTCCCGGTGCTGTGCCAGGCCCATGG

GTTAACCCCGGAACAAGTGGTTGCTATTGCTAGCCATGATGGCGGTAAACAGGCCC

TGGAGACCGTTCAGCGCCTGCTACCGGTGCTGTGCCAGGCCCATGGTTTAACCCCG

GAACAGGTTGTTGCGATTGCTAGCCACGATGGCGGCAAGCAGGCTCTGGAGACCGT

TCAGGCCCTGCTCCCGGTGCTGTGCCAGGCCCATGGGCTTACCCCGGAGCAAGTTG

TTGCTATTGCCTCCAATATTGGCGGTAAACAGGCGCTGGAAACCGTTCAGGCTCTG

CTTCCGGTGCTGTGCCAGGCTCATGGCCTCACCCCGGAACAAGTTGTGGCGATTGC

GTCCCATGATGGCGGCAAGCAGGCCCTGGAAACTGTGCAGGCGCTGCTACCGGTGC

TGTGCCAGGCCCATGGGCTAACCCCGGAACAGGTGGTTGCGATTGCTAGCAACAAC

GGCGGTAAACAGGCTCTGGAGACTGTTCAGCGTCTGCTTCCGGTGCTGTGCCAGGC

TCATGGGCTGACCCCGCAGCAAGTGGTTGCTATTGCCAGCAATGGCGGTGGCAAGC

AGGCGCTGGAGACTGTTCAGCGCCTGCTCCCGGTGCTGTGCCAGGCTCATGGTTTA

ACCCCGGAGCAGGTTGTGGCGATCGCCAGCAATGGTGGCGGTAAACAGGCTCTGG

AAACGGTGCAGGCCCTGCTCCCGGTGCTGTGCCAGGCTCATGGACTGACCCCGGAG

CAAGTTGTTGCCATTGCGTCCCACGACGGCGGCAAGCAGGCGCTGGAGACGGTGCA

GGCTCTGCTCCCGGTGCTGTGCCAGGCTCACGGTCTGACCCCGCAACAGGTGGTGG

CAATCGCAAGCAACGGTGGTGGTCGTCCGGCACTGGAGAGCATTGTGGCGCAGCTG

AGCCGTCCAGACCCGGCCCTGGCGGCTCTGACCAATGATCACCTGGTGGCCCTGGC

CTGCCTGGGTGGCCGTCCGGCTCTGGATGCCGTGAAGAAAGGTCTGGGC

Translated Amino Acid Sequence:

(SEQ ID NO: 315)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

-continued

GGVTAVEAVHAWRNALTGAPLNLTPEQVVAIASNNGGKQALETVQALLPVLCQAHGL

TPQQVVAIASHDGGKQALETVQRLLPVLCQAHGLTPQQVVAIASNGGGKQALETVQR

LLPVLCQAHGLTPEQVVAIASNIGGKQALETVQALLPVLCQAHGLTPEQVVAIASNNG

GKQALETVQALLPVLCQAHGLTPEQVVAIASNGGGKQALETVQALLPVLCQAHGLTPE

QVVAIASNIGGKQALETVQRLLPVLCQAHGLTPEQVVAIASNIGGKQALETVQALLPVL

CQAHGLTPEQVVAIASHDGGKQALETVQRLLPVLCQAHGLTPEQVVAIASHDGGKQA

LETVQALLPVLCQAHGLTPEQVVAIASNIGGKQALETVQALLPVLCQAHGLTPEQVVAI

ASHDGGKQALETVQALLPVLCQAHGLTPEQVVAIASNNGGKQALETVQRLLPVLCQA

HGLTPQQVVAIASNGGGKQALETVQRLLPVLCQAHGLTPEQVVAIASNGGGKQALETV

QALLPVLCQAHGLTPEQVVAIASHDGGKQALETVQALLPVLCQAHGLTPQQVVAIASN

GGGRPALESIVAQLSRPDPALAALTNDHLVALACLGGRPALDAVKKGLG (M) ND5.1-DdCBE Right mitoTALE repeat (SEQ ID NO: 316)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCACAGCAGGTGGTGGCAATCGCAAG

CCACGACGGAGGCAAGCAGGCCCTGGAGACCGTGCAGAGGCTGCTGCCCGTGCTG

TGCCAGGCACACGGACTGACACCTGAACAGGTCGTGGCAATCGCATCCAACGGAG

GCGGCAAGCAGGCCCTGGAAACCGTGCAGCGCCTGTTACCCGTGCTGTGCCAGGCC

CACGGCCTGACACCCCAGCAGGTGGTGGCCATCGCCTCTAATGGAGGGGGCAAGC

AGGCCCTGGAGACGGTGCAGCGGCTGCTGCCTGTGCTGTGCCAGGCTCATGGACTG

ACACCAGAACAGGTGGTCGCAATCGCAAGCAACGGAGGTGGCAAGCAGGCCCTGG

AGACTGTGCAGGCCCTGCTTCCCGTGCTGTGCCAGGCTCACGGACTGACACCTCAG

CAGGTCGTCGCCATCGCCTCCAACAATGGTGGCAAGCAGGCCCTGGAGACAGTGCA

GAGACTGCTGCCAGTGCTGTGCCAAGCCCATGGACTGACACCACAGCAGGTCGTCG

CTATCGCCTCTAATAACGGCGGCAAGCAGGCCCTGGAGACGGTACAGAGGCTGTTA

CCCGTGCTGTGCCAAGCACACGGACTGACACCAGAGCAGGTCGTCGCAATCGCCAG

CAATATCGGTGGCAAGCAGGCCCTGGAGACGGTCCAGCGCCTGCTCCCCGTGCTGT

GCCAAGCCCACGGCCTGACCCCTCAGCAGGTCGTGGCTATTGCTAGCAATAACGGG

GGCAAGCAGGCCCTGGAGACGGTTCAGCGGCTGTTGCCCGTGCTGTGCCAAGCCCA

CGGTCTGACCCCTCAGCAGGTGGTCGCTATTGCTTCTAATGGAGGAGGCAAGCAGG

CCCTGGAGACGGTACAGAGACTGTTACCTGTGCTGTGCCAGGCACATGGCCTGACA

CCAGAGCAGGTGGTCGCTATCGCCAGCAACATAGGTGGCAAGCAGGCCCTGGAGA

CGGTACAGAGGCTGCTTCCCGTGCTGTGCCAAGCTCATGGCCTGACACCTGAACAG

GTGGTCGCCATTGCTAGCAATAACGGTGGCAAGCAGGCCCTGGAGACGGTACAGC

GGCTGTTACCAGTGCTGTGCCAAGCACATGGCTTAACCCCTCAACAGGTCGTCGCA

-continued

ATTGCCTCTAATATCGGAGGCAAGCAGGCCCTGGAGACGGTACAGCGGCTGCTCCC

CGTGCTGTGCCAGGCGCACGGCCTGACTCCTCAGCAGGTCGTGGCAATCGCCAGCA

ACATCGGCGGCAGACCTGCCCTGGAGAGCATTGTGGCGCAGCTGAGCCGTCCAGAC

CCGGCCCTGGCGGCTCTGACCAATGATCACCTGGTGGCCCTGGCCTGCCTGGGTGG

CCGTCCGGCTCTGGATGCCGTGAAGAAAGGTCTGGGC

Translated Amino Acid Sequence:

(SEQ ID NO: 317)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPQQVVAIASHDGGKQALETVQRLLPVLCQAHGL

TPEQVVAIASNGGGKQALETVQRLLPVLCQAHGLTPQQVVAIASNGGGKQALETVQRL

LPVLCQAHGLTPEQVVAIASNGGGKQALETVQALLPVLCQAHGLTPQQVVAIASNNGG

KQALETVQRLLPVLCQAHGLTPQQVVAIASNNGGKQALETVQRLLPVLCQAHGLTPEQ

VVAIASNIGGKQALETVQRLLPVLCQAHGLTPQQVVAIASNNGGKQALETVQRLLPVL

CQAHGLTPQQVVAIASNGGGKQALETVQRLLPVLCQAHGLTPEQVVAIASNIGGKQAL

ETVQRLLPVLCQAHGLTPEQVVAIASNNGGKQALETVQRLLPVLCQAHGLTPQQVVAI

ASNIGGKQALETVQRLLPVLCQAHGLTPQQVVAIASNIGGRPALESIVAQLSRPDPALA

ALTNDHLVALACLGGRPALDAVKKGLG (N) ND5.1-DdCBE Left mitoTALE repeat (SEQ ID NO: 318)

CTGACCCCTGAGCAGGTGGTGGCCATCGCCAGCAATATCGGAGGCAAGCAGGCCCT

GGAGACCGTGCAGGCCCTGCTGCCCGTGCTGTGCCAGGCACACGGACTGACACCTC

AGCAGGTCGTCGCCATCGCCTCCAACAATGGCGGCAAGCAGGCCCTGGAAACCGTG

CAGAGGCTGTTACCCGTGCTGTGCCAGGCCCACGGCCTGACACCCCAGCAGGTGGT

GGCAATCGCATCTCACGATGGGGGCAAGCAGGCCCTGGAGACGGTGCAGCGCCTG

CTGCCTGTGCTGTGCCAGGCTCATGGACTGACACCAGAACAGGTCGTGGCCATCGC

CAGCAACATTGGCGGCAAGCAGGCCCTGGAGACTGTCCAGGCCCTGTTACCCGTGC

TGTGCCAAGCCCATGGACTGACACCTGAACAGGTCGTGGCAATCGCATCCAATGGA

GGTGGCAAGCAGGCCCTGGAGACAGTGCAGGCCCTGCTGCCAGTGCTGTGCCAGGC

TCACGGCCTGACACCAGAACAGGTGGTCGCAATCGCATCTAATGGAGGAGGCAAG

CAGGCCCTGGAGACGGTACAGGCCCTGTTGCCCGTGCTGTGCCAAGCCCACGGACT

GACACCAGAGCAGGTCGTCGCTATTGCTTCCAACATTGGAGGCAAGCAGGCCCTGG

AGACGGTCCAGCGGCTGCTTCCCGTGCTGTGCCAAGCTCATGGCCTGACACCAGAG

CAGGTGGTCGCTATTGCCTCCAACAATGGAGGCAAGCAGGCCCTGGAGACGGTTCA

GGCCCTGCTTCCCGTGCTGTGCCAGGCTCATGGTCTGACACCCGAACAGGTGGTCG

CTATCGCCTCTCACGATGGAGGCAAGCAGGCCCTGGAGACGGTACAGAGGCTGTTA

CCTGTGCTGTGCCAGGCCCATGGGCTGACCCCAGAACAGGTGGTCGCCATCGCCAG

CAACATCGGCGGCAAGCAGGCCCTGGAGACGGTACAGGCCCTGCTCCCCGTGCTGT

GCCAAGCACATGGCCTGACACCCGAGCAGGTCGTGGCTATTGCTAGCAACAACGGG

GGCAAGCAGGCCCTGGAGACGGTACAGGCCCTGCTACCAGTGCTGTGCCAAGCGC

ACGGGCTGACCCCAGAGCAGGTCGTCGCAATCGCCTCTAACAACGGTGGCAAGCA

-continued

GGCCCTGGAGACGGTACAGGCCCTGCTGCCCGTGCTGTGCCAAGCGCATGGGCTGA

CTCCAGAACAGGTGGTGGCTATCGCCAGCAACATTGGAGGCAAGCAGGCCCTGGA

GACGGTACAGCGGCTGCTACCCGTGCTGTGCCAAGCGCACGGTCTGACACCTCAGC

AGGTGGTCGCTATCGCTTCTAACATAGGGGGCAAGCAGGCCCTGGAGACGGTACAG

CGGCTGCTGCCCGTGCTGTGCCAAGCGCACGGACTGACCCCACAGCAGGTCGTCGC

TATCGCCTCTAACGGAGGAGGCAGACCCGCCCTGGAG

Translated Amino Acid Sequence:

(SEQ ID NO: 319)

LTPEQVVAIASNIGGKQALETVQALLPVLCQAHGLTPQQVVAIASNNGGKQALETVQR

LLPVLCQAHGLTPQQVVAIASHDGGKQALETVQRLLPVLCQAHGLTPEQVVAIASNIG

GKQALETVQALLPVLCQAHGLTPEQVVAIASNGGGKQALETVQALLPVLCQAHGLTPE

QVVAIASNGGGKQALETVQALLPVLCQAHGLTPEQVVAIASNIGGKQALETVQRLLPV

LCQAHGLTPEQVVAIASNNGGKQALETVQALLPVLCQAHGLTPEQVVAIASHDGGKQ

ALETVQRLLPVLCQAHGLTPEQVVAIASNIGGKQALETVQALLPVLCQAHGLTPEQVV

AIASNNGGKQALETVQALLPVLCQAHGLTPEQVVAIASNNGGKQALETVQALLPVLCQ

AHGLTPEQVVAIASNIGGKQALETVQRLLPVLCQAHGLTPQQVVAIASNIGGKQALETV

QRLLPVLCQAHGLTPQQVVAIASNGGGRPALE (O) ND5.2-DdCBE Right mitoTALE repeat (SEQ ID NO: 320)

GACATCGCGGATCTGCGTACCCTGGGTTACAGCCAGCAGCAGCAGGAGAAGATCA

AGCCGAAGGTGCGCAGCACCGTGGCTCAGCACCACGAAGCCCTGGTGGGCCACGG

TTTCACCCACGCTCACATCGTGGCCCTGAGCCAGCACCCAGCCGCGCTGGGCACCG

TGGCCGTGAAATATCAGGACATGATTGCTGCCCTGCCAGAGGCCACCCATGAAGCT

ATTGTGGGCGTGGGCAAGCAGTGGAGCGGTGCTCGTGCGCTGGAGGCGCTGCTGAC

CGTGGCTGGTGAACTGCGTGGTCCGCCGCTGCAGCTGGATACCGGTCAGCTGCTGA

AAATTGCCAAACGTGGCGGTGTGACCGCGGTGGAAGCCGTGCATGCTTGGCGTAAT

GCTCTGACCGGTGCGCCGCTGAACCTGACCCCGCAGCAGGTGGTGGCTATTGCCAG

CAACAACGGCGGTAAACAGGCTCTGGAGACCGTGCAGCGTCTGCTGCCGGTGCTGT

GCCAGGCTCATGGTCTGACCCCGGAGCAGGTGGTGGCCATTGCTAGCCATGATGGC

GGCAAGCAGGCGCTGGAAACCGTGCAGCGCCTGTTACCGGTGCTGTGCCAAGCCCA

TGGTCTGACCCCGCAGCAAGTIGTGGCTATTGCGAGCAACGGCGGTGGCAAACAGG

CCCTGGAAACCGTTCAGCGTCTGTTACCGGTGCTGTGCCAGGCCCATGGCCTGACC

CCGGAACAAGTGGTGGCTATCGCCAGCAACATTGGTGGCAAGCAGGCCCTGGAAA

CCGTGCAGGCGCTGTTGCCGGTGCTGTGCCAAGCCCATGGGCTGACCCCGCAGCAA

GTGGTTGCGATCGCTAGCAACAACGGTGGCAAACAGGCTCTGGAAACCGTTCAGCG

CCTGCTTCCGGTGCTGTGCCAAGCGCATGGCTTAACCCCGCAGCAAGTTGTGGCCA

TTGCGAGCAACAACGGTGGCAAGCAGGCGCTGGAGACCGTTCAGCGTCTGCTTCCG

GTGCTGTGCCAGGCGCATGGCCTGACCCCGGAGCAAGTGGTGGCTATTGCTAGCCA

CGATGGTGGCAAACAGGCCCTGGAGACCGTGCAGCGCCTGCTCCCGGTGCTGTGCC

AGGCCCATGGATTAACCCCGCAGCAAGTGGTGGCCATCGCCAGCAATGGCGGCGG

CAAGCAGGCTCTGGAAACTGTGCAGCGTCTGTTACCGGTGCTGTGCCAGGCCCATG

-continued

GGTTAACCCCGCAGCAGGTTGTTGCCATTGCCTCCAATAATGGCGGTAAACAGGCG

CTGGAGACTGTGCAGCGCCTGCTACCGGTGCTGTGCCAGGCACATGGTCTGACCCC

GGAACAAGTTGTTGCCATTGCGTCCCATGATGGCGGCAAGCAGGCCCTGGAGACTG

TTCAGCGTCTGCTCCCGGTGCTGTGCCAGGCCCATGGTTTAACCCCGGAACAAGTTG

TGGCCATTGCTAGCCACGATGGCGGTAAACAGGCTCTGGAAACTGTTCAGCGCCTG

CTGCCGGTGCTGTGCCAAGCACATGGCTTAACCCCGGAACAGGTTGTTGCTATTGC

CAGCAACATCGGCGGCAAGCAGGCTCTGGAGACCGTTCAGGCCCTGTTGCCGGTGC

TGTGCCAGGCCCATGGGCTTACCCCGGAACAAGTGGTTGCCATCGCCAGCAACATT

GGCGGTAAACAGGCGCTGGAAACCGTTCAGGCTCTGTTGCCGGTGCTGTGCCAGGC

TCATGGCCTTACCCCGCAGCAAGTTGTGGCGATTGCTAGCAATGGCGGTGGCAAGC

AGGCGCTGGAGACGGTTCAGCGTCTGCTACCGGTGCTGTGCCAGGCTCATGGATTG

ACCCCGCAGCAGGTCGTGGCCATTGCCTCCAATAACGGTGGCAAACAGGCGCTGGA

GACAGTTCAGCGCCTGCTGCCGGTGCTGTGCCAGGCTCATGGTTGACCCCGCAGC

AGGTAGTTGCTATTGCTAGCAATGGTGGCGGTCGTCCGGCCCTGGAGAGCATTGTG

GCGCAGCTGAGCCGTCCAGACCCGGCGCTGGCGGCTCTGACCAACGATCACCTGGT

GGCGCTGGCTTGCCTGGGCGGTCGTCCGGCCCTGGATGCCGTGAAGAAAGGCCTGG

GT

Translated Amino Acid Sequence:

(SEQ ID NO: 321)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPQQVVAIASNNGGKQALETVQRLLPVLCQAHGL

TPEQVVAIASHDGGKQALETVQRLLPVLCQAHGLTPQQVVAIASNGGGKQALETVQRL

LPVLCQAHGLTPEQVVAIASNIGGKQALETVQALLPVLCQAHGLTPQQVVAIASNNGG

KQALETVQRLLPVLCQAHGLTPQQVVAIASNNGGKQALETVQRLLPVLCQAHGLTPEQ

VVAIASHDGGKQALETVQRLLPVLCQAHGLTPQQVVAIASNGGGKQALETVQRLLPVL

CQAHGLTPQQVVAIASNNGGKQALETVQRLLPVLCQAHGLTPEQVVAIASHDGGKQA

LETVQRLLPVLCQAHGLTPEQVVAIASHDGGKQALETVQRLLPVLCQAHGLTPEQVVA

IASNIGGKQALETVQALLPVLCQAHGLTPEQVVAIASNIGGKQALETVQALLPVLCQAH

GLTPQQVVAIASNGGGKQALETVQRLLPVLCQAHGLTPQQVVAIASNNGGKQALETV

QRLLPVLCQAHGLTPQQVVAIASNGGGRPALESIVAQLSRPDPALAALTNDHLVALAC

LGGRPALDAVKKGLG (P) ND5.2-DdCBE Left mitoTALE repeat (SEQ ID NO: 322)

GACATCGCGGATCTGCGTACCCTGGGTTACAGCCAGCAGCAGCAGGAGAAGATCA

AGCCGAAGGTGCGCAGCACCGTGGCTCAGCACCACGAAGCCCTGGTGGGCCACGG

TTTCACCCACGCTCACATTGTGGCCCTGAGCCAGCACCCAGCCGCGCTGGGCACCG

TGGCCGTGAAATATCAGGATATGATTGCTGCCCTGCCAGAGGCCACCCATGAAGCT

ATTGTGGGCGTGGGCAAGCAGTGGAGCGGTGCTCGTGCGCTGGAGGCGCTGCTGAC

CGTGGCTGGTGAACTGCGTGGTCCGCCGCTGCAGCTGGACACCGGTCAGCTGCTGA

AAATCGCGAAACGTGGCGGTGTGACCGCGGTGGAAGCCGTGCATGCTTGGCGTAAT

-continued

GCTCTGACCGGTGCGCCGCTGAACCTGACCCCTGAGCAGGTGGTGGCAATCGCAAG

CCACGACGGAGGCAAGCAGGCCCTGGAGACAGTGCAGGCCCTGCTGCCCGTGCTGT

GCCAGGCACACGGCCTGACACCTGAGCAGGTGGTGGCCATCGCCTCCAACATCGGC

GGCAAGCAGGCCCTGGAGACAGTACAGAGGCTGTTACCCGTGCTGTGCCAGGCCCA

CGGCCTGACACCCCAGCAGGTCGTCGCCATCGCCTCTAATATTGGAGGCAAGCAGG

CCCTGGAGACAGTCCAGCGCCTGCTGCCTGTGCTGTGCCAGGCTCATGGCCTGACA

CCAGAACAGGTCGTGGCCATCGCCAGTAATATTGGGGGCAAGCAGGCCCTGGAGA

CAGTTCAGGCCCTGTTACCCGTGCTGTGCCAAGCCCATGGCCTGACACCTGAACAG

GTGGTCGCCATCGCCTCCAATATTGGTGGCAAGCAGGCCCTGGAGACAGTACAGGC

CCTGCTGCCAGTGCTGTGCCAGGCTCACGGCCTGACACCAGAGCAGGTCGTCGCAA

TCGCATCTCATGATGGCGGCAAGCAGGCCCTGGAGACAGTACAGGCCCTGTTACCC

GTGCTGTGCCAAGCGCACGGCCTGACCCCTGAACAGGTCGTGGCTATTGCAAGCCA

CGATGGTGGCAAGCAGGCCCTGGAGACAGTACAGCGGCTGCTTCCCGTGCTGTGCC

AAGCTCATGGCCTGACACCTGAGCAGGTCGTCGCTATTGCTAGCAATATTGGCGGC

AAGCAGGCCCTGGAGACAGTACAGGCCCTGCTCCCCGTGCTGTGCCAAGCACACGG

CCTGACACCCGAACAGGTGGTGGCTATCGCCTCTAATGGAGGTGGCAAGCAGGCCC

TGGAGACAGTACAGAGGCTGCTTCCTGTGCTGTGCCAGGCCCATGGCCTGACCCCT

GAGCAGGTCGTGGCTATTGCCAGTAATATAGGAGGCAAGCAGGCCCTGGAGACAG

TACAGGCCCTGCTACCCGTGCTGTGCCAAGCGCATGGCCTGACCCCAGAACAGGTC

GTGGCAATCGCATCTCATGACGGCGGCAAGCAGGCCCTGGAGACAGTACAGGCCCT

GCTACCAGTGCTGTGCCAAGCACATGGCCTGACCCCCGAACAGGTGGTGGCAATCG

CCTCTCACGACGGGGGCAAGCAGGCCCTGGAGACAGTACAGGCCCTGCTACCCGTG

CTGTGCCAAGCGCACGGCCTGACGCCAGAACAGGTGGTCGCTATCGCAAGCAACG

GCGGTGGCAAGCAGGCCCTGGAGACAGTACAGCGGCTGCTACCCGTGCTGTGCCAA

GCGCACGGCCTGACTCCTCAGCAGGTCGTCGCTATCGCATCTCATGATGGTGGCAA

GCAGGCCCTGGAGACAGTACAGCGGCTGCTACCCGTGCTGTGCCAAGCGCACGGCC

TGACACCACAGCAGGTCGTCGCAATTGCATCTAACGGAGGAGGCAGACCCGCCCTG

GAGAGCATTGTGGCTCAGCTGAGCCGTCCAGACCCGGCCCTGGCGGCTCTGACCAA

CGATCACCTGGTGGCGCTGGCTTGCCTGGGCGGTCGTCCGGCCCTGGATGCGGTGA

AGAAAGGCCTGGGT

Translated Amino Acid Sequence:

(SEQ ID NO: 323)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASHDGGKQALETVQALLPVLCQAHGL

TPEQVVAIASNIGGKQALETVQRLLPVLCQAHGLTPQQVVAIASNIGGKQALETVQRLL

PVLCQAHGLTPEQVVAIASNIGGKQALETVQALLPVLCQAHGLTPEQVVAIASNIGGKQ

ALETVQALLPVLCQAHGLTPEQVVAIASHDGGKQALETVQALLPVLCQAHGLTPEQVV

AIASHDGGKQALETVQRLLPVLCQAHGLTPEQVVAIASNIGGKQALETVQALLPVLCQ

AHGLTPEQVVAIASNGGGKQALETVQRLLPVLCQAHGLTPEQVVAIASNIGGKQALET

-continued

VQALLPVLCQAHGLTPEQVVAIASHDGGKQALETVQALLPVLCQAHGLTPEQVVAIAS

HDGGKQALETVQALLPVLCQAHGLTPEQVVAIASNGGGKQALETVQRLLPVLCQAHG

LTPQQVVAIASHDGGKQALETVQRLLPVLCQAHGLTPQQVVAIASNGGGRPALESIVA

QLSRPDPALAALTNDHLVALACLGGRPALDAVKKGLG (Q) ND5.3-DdCBE Right mitoTALE repeat (SEQ ID NO: 324)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACACCACAGCAGGTCGTCGCTATCGCTTC

AAACATTGGGGGGAAACAGGCACTGGAAACCGTCCAGAGACTGCTGCCCGTCCTGT

GCCAGGCCCACGGCCTGACCCCTGAGCAGGTGGTGGCCATCGCCAGCAATATCGGA

GGCAAGCAGGCCCTGGAGACCGTGCAGCGGCTGCTGCCCGTGCTGTGCCAAGCCCA

CGGCTTAACACCTCAGCAGGTCGTGGCTATCGCCTCCAACAATGGCGGCAAGCAGG

CCCTGGAGACGGTGCAGAGACTGCTGCCAGTGCTGTGCCAGGCCCACGGCTTAACA

CCAGAACAGGTCGTGGCCATCGCCTCTAACATTGGCGGCAAGCAGGCCCTGGAGAC

TGTGCAGGCCCTGCTGCCCGTGCTGTGCCAGGCCCACGGCCTTACACCACAGCAGG

TGGTGGCAATCGCCAGCAATGGAGGGGGCAAGCAGGCCCTGGAGACAGTGCAGAG

GCTGCTGCCCGTGCTGTGCCAAGCCCACGGCCTGACACCTCAGCAGGTGGTCGCCA

TCGCCTCCAACGGAGGTGGCAAGCAGGCCCTGGAGACGGTACAGCGCCTGCTGCCC

GTGCTGTGCCAAGCCCACGGCCTAACACCCGAACAGGTCGTCGCCATCGCCTCTAA

CATCGGCGGCAAGCAGGCCCTGGAGACGGTCCAGCGGCTGCTGCCTGTGCTGTGCC

AAGCCCACGGCCTTACCCCTCAGCAGGTCGTGGCAATCGCCAGCAACAATGGTGGC

AAGCAGGCCCTGGAGACGGTTCAGAGACTGCTGCCCGTGCTGTGCCAAGCCCACGG

CCTCACACCTCAGCAGGTGGTGGCCATTGCCTCCAACGGAGGAGGCAAGCAGGCCC

TGGAGACGGTACAGAGGCTGCTGCCAGTGCTGTGCCAGGCCCACGGCCTAACACCA

GAACAGGTGGTCGCTATTGCCTCTAACATTGGTGGCAAGCAGGCCCTGGAGACGGT

ACAGCGCCTGCTGCCCGTGCTGTGCCAAGCCCACGGCCTAACGCCAGAACAGGTCG

TCGCTATCGCCAGCAACGGAGGAGGCAAGCAGGCCCTGGAGACGGTACAGCGGCT

GCTGCCCGTGCTGTGCCAAGCCCACGGCCTAACCCCACAGCAGGTCGTGGCCATTG

CCTCCAATAACGGCGGCAAGCAGGCCCTGGAGACGGTACAGCGGCTGCTGCCCGTG

CTGTGCCAAGCCCACGGCCTAACTCCCCAGCAAGTCGTCGCTATTGCCTCTAATAAC

GGGGGCAAGCAGGCCCTGGAGACGGTACAGAGACTGCTGCCCGTGCTGTGCCAAG

CCCACGGCCTGACACCACAGCAGGTCGTCGCCATCGCAAGCAACGGAGGAGGGAG

GCCCGCACTGGAGAGCATTGTGGCGCAGCTGAGCCGTCCAGACCCGGCCCTGGCGG

CTCTGACCAATGATCACCTGGTGGCCCTGGCCTGCCTGGGTGGCCGTCCGGCTCTGG

ATGCCGTGAAGAAAGGTCTGGGC

Translated Amino Acid Sequence:

(SEQ ID NO: 325)
DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPQQVVAIASNIGGKQALETVQRLLPVLCQAHGL

TPEQVVAIASNIGGKQALETVQRLLPVLCQAHGLTPQQVVAIASNNGGKQALETVQRL

LPVLCQAHGLTPEQVVAIASNIGGKQALETVQALLPVLCQAHGLTPQQVVAIASNGGG

KQALETVQRLLPVLCQAHGLTPQQVVAIASNGGGKQALETVQRLLPVLCQAHGLTPEQ

VVAIASNIGGKQALETVQRLLPVLCQAHGLTPQQVVAIASNNGGKQALETVQRLLPVL

CQAHGLTPQQVVAIASNGGGKQALETVQRLLPVLCQAHGLTPEQVVAIASNIGGKQAL

ETVQRLLPVLCQAHGLTPEQVVAIASNGGGKQALETVQRLLPVLCQAHGLTPQQVVAI

ASNNGGKQALETVQRLLPVLCQAHGLTPQQVVAIASNNGGKQALETVQRLLPVLCQA

HGLTPQQVVAIASNGGGRPALESIVAQLSRPDPALAALTNDHLVALACLGGRPALDAV

KKGLG (R) ND5.3-DdCBE Left mitoTALE repeat (SEQ ID NO: 326)
GACATCGCGGATCTGCGTACCCTGGGTTACAGCCAGCAGCAGCAGGAGAAGATCA

AGCCGAAGGTGCGCAGCACCGTGGCTCAGCACCACGAAGCCCTGGTGGGCCACGG

TTTCACCCACGCTCACATTGTGGCCCTGAGCCAGCACCCAGCCGCGCTGGGCACCG

TGGCCGTGAAATATCAGGATATGATTGCTGCCCTGCCAGAGGCCACCCATGAAGCT

ATTGTGGGCGTGGGCAAGCAGTGGAGCGGTGCTCGTGCGCTGGAGGCGCTGCTGAC

CGTGGCTGGTGAACTGCGTGGTCCGCCGCTGCAGCTGGACACCGGTCAGCTGCTGA

AAATCGCGAAACGTGGCGGTGTGACCGCGGTGGAAGCCGTGCATGCTTGGCGTAAT

GCTCTGACCGGTGCGCCGCTGAACCTGACTCCCGAACAGGTGGTCGCTATCGCTTCT

CATGATGGCGGAAAACAGGCTCTGGAAACCGTCCAGGCTCTGCTGCCCGTGCTGTG

CCAGGCCCACGGCCTGACCCCACAGCAGGTCGTCGCAATCGCCAGCAATATCGGAG

GCAAGCAGGCCCTGGAGACCGTGCAGCGGCTGCTGCCCGTGCTGTGCCAAGCCCAC

GGCTTAACACCTCAGCAGGTGGTGGCCATCGCCTCCAACAATGGCGGCAAGCAGGC

CCTGGAGACGGTGCAGAGACTGCTGCCAGTGCTGTGCCAGGCCCACGGCTTAACAC

CAGAACAGGTCGTGGCAATCGCCTCTAACGGAGGGGGCAAGCAGGCCCTGGAGAC

TGTGCAGGCCCTGCTGCCCGTGCTGTGCCAGGCCCACGGCCTTACACCAGAACAGG

TGGTCGCCATTGCCAGCAATGGAGGTGGCAAGCAGGCCCTGGAGACAGTCCAGGC

CCTGCTGCCCGTGCTGTGCCAAGCCCACGGCCTGACACCTGAACAGGTGGTCGCAA

TCGCCTCCCACGATGGGGGCAAGCAGGCCCTGGAGACGGTACAGGCCCTGCTGCCC

GTGCTGTGCCAAGCCCACGGCCTAACACCCGAACAGGTGGTGGCCATTGCCTCTAA

CGGAGGAGGCAAGCAGGCCCTGGAGACGGTCCAGCGGCTGCTGCCTGTGCTGTGCC

AAGCCCACGGCCTTACCCCTGAACAAGTCGTGGCCATCGCCAGCAATGGAGGAGGC

AAGCAGGCCCTGGAGACGGTTCAGGCCCTGCTGCCCGTGCTGTGCCAAGCCCACGG

CCTCACACCTGAACAAGTTGTGGCCATCGCCTCCCACGATGGTGGCAAGCAGGCCC

TGGAGACGGTACAGAGGCTGCTGCCAGTGCTGTGCCAGGCCCACGGCCTAACACCA

GAACAGGTGGTGGCTATCGCCTCTAACATTGGCGGCAAGCAGGCCCTGGAGACGGT

ACAGGCCCTGCTGCCCGTGCTGTGCCAAGCCCACGGCCTAACGCCAGAACAGGTCG

-continued

TCGCTATTGCCAGCAACATTGGGGGCAAGCAGGCCCTGGAGACGGTACAGGCCCTG

CTGCCCGTGCTGTGCCAAGCCCACGGCCTAACCCCTGAACAGGTGGTGGCAATCGC

CTCCAACATTGGTGGCAAGCAGGCCCTGGAGACGGTACAGGCCCTGCTGCCCGTGC

TGTGCCAAGCCCACGGCCTAACTCCCGAGCAGGTCGTCGCCATCGCCTCTAATGGC

GGCGGCAAGCAGGCCCTGGAGACGGTACAGAGGCTGCTGCCTGTGCTGTGCCAAG

CCCACGGCCTAACGCCGCAGCAAGTCGTCGCTATTGCCAGCAATATTGGCGGCAAG

CAGGCCCTGGAGACGGTACAGCGCCTGCTGCCCGTGCTGTGCCAAGCCCACGGCCT

GACCCCCCAGCAGGTGGTGGCAATCGCTTCAAACGGAGGAGGGAGACCCGCTCTG

GAAAGCATTGTGGCTCAGCTGAGCCGTCCAGACCCGGCCCTGGCGGCTCTGACCAA

CGATCACCTGGTGGCGCTGGCTTGCCTGGGCGGTCGTCCGGCCCTGGATGCGGTGA

AGAAAGGCCTGGGT

Translated Amino Acid Sequence:

(SEQ ID NO: 327)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASHDGGKQALETVQALLPVLCQAHGL

TPQQVVAIASNIGGKQALETVQRLLPVLCQAHGLTPQQVVAIASNNGGKQALETVQRL

LPVLCQAHGLTPEQVVAIASNGGGKQALETVQALLPVLCQAHGLTPEQVVAIASNGGG

KQALETVQALLPVLCQAHGLTPEQVVAIASHDGGKQALETVQALLPVLCQAHGLTPEQ

VVAIASNGGGKQALETVQRLLPVLCQAHGLTPEQVVAIASNGGGKQALETVQALLPVL

CQAHGLTPEQVVAIASHDGGKQALETVQRLLPVLCQAHGLTPEQVVAIASNIGGKQAL

ETVQALLPVLCQAHGLTPEQVVAIASNIGGKQALETVQALLPVLCQAHGLTPEQVVAIA

SNIGGKQALETVQALLPVLCQAHGLTPEQVVAIASNGGGKQALETVQRLLPVLCQAHG

LTPQQVVAIASNIGGKQALETVQRLLPVLCQAHGLTPQQVVAIASNGGGRPALESIVAQ

LSRPDPALAALTNDHLVALACLGGRPALDAVKKGLG (S) ATP8-DdCBE Right mitoTALE repeat (SEQ ID NO: 328)

GACATCGCGGATCTGCGTACCCTGGGTTACAGCCAGCAGCAGCAGGAGAAGATCA

AGCCAAAGGTGCGCAGCACCGTGGCCCAGCACCATGAAGCTCTGGTGGGTCACGG

CTTCACCCACGCGCACATCGTGGCTCTGAGCCAGCACCCAGCCGCGCTGGGTACCG

TGGCCGTGAAATATCAGGACATGATTGCTGCCCTGCCAGAGGCTACCCATGAAGCG

ATTGTGGGTGTGGGCAAGCAGTGGAGCGGTGCTCGTGCGCTGGAGGCCCTGCTGAC

CGTGGCCGGTGAACTGCGTGGCCCGCCGCTGCAGCTGGATACCGGCCAGCTGCTGA

AAATCGCGAAACGTGGCGGTGTGACCGCTGTGGAAGCTGTGCATGCCTGGCGTAAT

GCTCTGACCGGTGCCCCGCTGAACCTGACCCCTCAGCAGGTGGTGGCCATCGCCAG

CAACATCGGCGGCAAGCAGGCCCTGGAGACAGTGCAGAGGCTGCTGCCCGTGCTGT

GCCAGGCACACGGCCTGACACCTGAGCAGGTGGTGGCAATCGCATCCAATGGAGG

AGGCAAGCAGGCCCTGGAGACAGTACAGCGCCTGTTACCCGTGCTGTGCCAGGCCC

ACGGCCTGACACCCCAGCAGGTCGTCGCCATCGCCTCTAACAATGGGGGCAAGCAG

GCCCTGGAGACAGTCCAGCGGCTGCTGCCTGTGCTGTGCCAGGCTCATGGCCTGAC

ACCAGAACAGGTCGTGGCTATTGCCAGCAACAATGGTGGCAAGCAGGCCCTGGAG

-continued

ACAGTTCAGGCCCTGCTTCCCGTGCTGTGCCAGGCTCACGGCCTGACACCACAGCA

GGTCGTGGCCATCGCCTCCAACAATGGCGGCAAGCAGGCCCTGGAGACAGTACAG

AGACTGCTGCCAGTGCTGTGCCAAGCCCATGGCCTGACCCCTCAGCAGGTCGTGGC

AATCGCATCTCACGACGGTGGCAAGCAGGCCCTGGAGACAGTACAGAGGCTGTTAC

CCGTGCTGTGCCAAGCACACGGCCTGACACCAGAGCAGGTCGTCGCAATCGCAAGC

AACGGCGGCGGCAAGCAGGCCCTGGAGACAGTACAGCGCCTGCTCCCCGTGCTGTG

CCAAGCCCACGGCCTGACACCTCAGCAGGTGGTCGCCATTGCCAGCAACGGCGGGG

GCAAGCAGGCCCTGGAGACAGTACAGCGGCTGTTGCCCGTGCTGTGCCAAGCCCAC

GGCCTGACGCCCCAGCAGGTGGTCGCCATCGCATCTAACGGCGGTGGCAAGCAGGC

CCTGGAGACAGTACAGCGGCTGCTTCCTGTGCTGTGCCAGGCCCATGGCCTGACCC

CCGAACAGGTCGTGGCTATCGCTAGCAACAATGGCGGCAAGCAGGCCCTGGAGAC

AGTACAGAGACTGTTACCCGTGCTGTGCCAAGCGCATGGCCTGACCCCTGAACAGG

TCGTGGCAATTGCCTCCAATAACGGTGGCAAGCAGGCCCTGGAGACAGTACAGCGG

CTGCTACCAGTGCTGTGCCAAGCACATGGCCTGACCCCCCAGCAGGTCGTGGCTAT

TGCATCTAATGGAGGAGGCAGACCCGCCCTGGAGAGCATTGTGGCGCAGCTGAGCC

GTCCAGACCCGGCCCTGGCGGCTCTGACCAATGATCACCTGGTGGCCCTGGCCTGC

CTGGGTGGCCGTCCGGCTCTGGATGCCGTGAAGAAAGGTCTGGGC

Translated Amino Acid Sequence:

(SEQ ID NO: 329)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASNIGGKQALETVQRLLPVLCQAHGL
TPEQVVAIASNGGGKQALETVQRLLPVLCQAHGLTPQQVVAIASNNGGKQALETVQRL
LPVLCQAHGLTPEQVVAIASNNGGKQALETVQALLPVLCQAHGLTPQQVVAIASNNGG
KQALETVQRLLPVLCQAHGLTPQQVVAIASHDGGKQALETVQRLLPVLCQAHGLTPEQ
VVAIASNGGGKQALETVQRLLPVLCQAHGLTPQQVVAIASNGGGKQALETVQRLLPVL
CQAHGLTPQQVVAIASNGGGKQALETVQRLLPVLCQAHGLTPEQVVAIASNNGGKQA
LETVQRLLPVLCQAHGLTPEQVVAIASNNGGKQALETVQRLLPVLCQAHGLTPQQVVA
IASNGGGRPALESIVAQLSRPDPALAALTNDHLVALACLGGRPALDAVKKGLG (T) ATP8-DdCBE Left mitoTALE repeat (SEQ ID NO: 330)

GACATCGCGGATCTGCGTACCCTGGGTTACAGCCAGCAGCAGCAGGAGAAGATCA
AGCCGAAGGTGCGCAGCACCGTGGCTCAGCACCACGAAGCCCTGGTGGGCCACGG
TTTCACCCACGCTCACATCGTGGCCCTGAGCCAGCACCCAGCCGCGCTGGGCACCG
TGGCCGTGAAATATCAGGACATGATTGCTGCCCTGCCAGAGGCCACCCATGAAGCT
ATTGTGGGCGTGGGCAAGCAGTGGAGCGGTGCTCGTGCGCTGGAGGCGCTGCTGAC
CGTGGCTGGTGAACTGCGTGGTCCGCCGCTGCAGCTGGATACCGGTCAGCTGCTGA
AAATCGCGAAACGTGGCGGTGTGACCGCGGTGGAAGCCGTGCATGCTTGGCGTAAT
GCTCTGACCGGTGCGCCGCTGAACCTGACCCCGGAGCAGGTGGTGGCTATCGCCAG
CAACATTGGCGGTAAACAGGCCCTGGAAACCGTGCAGGCGCTGCTGCCGGTGCTGT
GCCAGGCTCATGGTCTGACCCCGCAGCAGGTGGTGGCGATCGCTAGCAACGGCGGT
GGCAAGCAGGCTCTGGAGACCGTGCAGCGTCTGTTACCGGTGCTGTGCCAAGCCCA
TGGCCTGACCCCGCAGCAAGTTGTGGCCATTGCGAGCAATGGTGGCGGTAAACAGG
CGCTGGAAACCGTGCAGCGCCTGTTGCCGGTGCTGTGCCAAGCCCATGGGCTGACC
CCGGAACAAGTTGTTGCTATCGCCAGCAACATCGGCGGCAAGCAGGCTCTGGAAAC
CGTGCAGGCCCTGCTTCCGGTGCTGTGCCAAGCGCATGGTCTGACCCCGGAACAAG
TGGTGGCCATCGCTTCCAATATTGGCGGTAAACAGGCGCTGGAGACCGTGCAGGCT
CTGCTCCCGGTGCTGTGCCAAGCACATGGTCTGACCCCGGAGCAAGTTGTGGCTAT
TGCCTCCAATATCGGCGGCAAGCAGGCCCTGGAGACCGTTCAGGCGCTGTTACCGG
TGCTGTGCCAGGCCCATGGATTAACCCCGGAGCAAGTGGTGGCTATTGCTAGCCAT
GATGGCGGTAAACAGGCCCTGGAGACTGTTCAGCGTCTGCTACCGGTGCTGTGCCA
GGCCCATGGTTTAACCCCGGAACAGGTTGTTGCCATCGCTTCCAACATCGGCGGCA
AGCAGGCTCTGGAAACGGTGCAGGCCCTGTTACCGGTGCTGTGCCAGGCCCATGGG
TTAACCCCGGAACAAGTTGTGGCCATTGCCTCCCATGACGGCGGTAAACAGGCTCT
GGAGACCGTTCAGCGCCTGCTACCGGTGCTGTGCCAGGCGCATGGCTTAACCCCGG
AACAAGTGGTTGCCATTGCGTCCAATATCGGCGGCAAGCAGGCGCTGGAGACCGTT
CAGGCTCTGCTTCCGGTGCTGTGCCAGGCACATGGCCTTACCCCGGAACAAGTGGT
CGCGATCGCTTCCAACATTGGCGGTAAACAGGCCCTGGAAACGGTTCAGGCGCTGC
TTCCGGTGCTGTGCCAGGCCCATGGGCTTACCCCGGAACAGGTTGTGGCTATTGCC
AGTAATATCGGCGGCAAGCAGGCTCTGGAAACTGTGCAGGCCCTGCTACCGGTGCT

-continued

GTGCCAGGCTCATGGGCTGACCCCGGAGCAAGTGGTTGCCATTGCCTCCCATGATG
GCGGTAAACAGGCGCTGGAAACGGTGCAGCGTCTGCTTCCGGTGCTGTGCCAGGCT
CATGGCTTAACCCCGCAGCAAGTTGTTGCGATTGCTAGCAATGGCGGTGGCAAGCA
GGCCCTGGAAACTGTTCAGCGCCTGTTACCGGTGCTGTGCCAGGCCCATGGGCTAA
CCCCGGAACAGGTGGTTGCTATTGCCAGCAACATTGGTGGCAAACAGGCGCTGGAA
ACTGTGCAGGCTCTGCTTCCGGTGCTGTGCCAGGCCCATGGGCTGACCCCGCAGCA
AGTGGTTGCTATTGCTAGCAATGGTGGCGGTCGTCCGGCCCTGGAGAGCATTGTGG
CGCAGCTGAGCCGTCCAGACCCGGCCCTGGCGGCTCTGACCAACGATCACCTGGTG
GCGCTGGCTTGCCTGGGCGGTCGTCCGGCCCTGGATGCGGTGAAGAAAGGCCTGGG
T

Translated Amino Acid Sequence:

(SEQ ID NO: 331)

DIADLRTLGYSQQQQEKIKPKVRSTVAQHHEALVGHGFTHAHIVALSQHP
AALGTVAVKYQDMIAALPEATHEAIVGVGKQWSGARALEALLTVAGELRG
PPLQLDTGQLLKIAKRGGVTAVEAVHAWRNALTGAPLNLTPEQVVAIASN
IGGKQALETVQALLPVLCQAHGLTPQQVVAIASNGGGKQALETVQRLLPV
LCQAHGLTPQQVVAIASNGGGKQALETVQRLLPVLCQAHGLTPEQVVAIA
SNIGGKQALETVQALLPVLCQAHGLTPEQVVAIASNIGGKQALETVQALL
PVLCQAHGLTPEQVVAIASNIGGKQALETVQALLPVLCQAHGLTPEQVVA
IASHDGGKQALETVQRLLPVLCQAHGLTPEQVVAIASNIGGKQALETVQA
LLPVLCQAHGLTPEQVVAIASHDGGKQALETVQRLLPVLCQAHGLTPEQV
VAIASNIGGKQALETVQALLPVLCQAHGLTPEQVVAIASNIGGKQALETV
QALLPVLCQAHGLTPEQVVAIASNIGGKQALETVQALLPVLCQAHGLTPE

-continued

QVVAIASHDGGKQALETVQRLLPVLCQAHGLTPQQVVAIASNGGGKQALE
TVQRLLPVLCQAHGLTPEQVVAIASNIGGKQALETVQALLPVLCQAHGLT
PQQVVAIASNGGGRPALESIVAQLSRPDPALAALTNDHLVALACLGGRPA
LDAVKKGLG

Other exemplary mtDNA base editors may comprise DdCBE/mitoTALE fusion proteins, as follows:

All right-side halves of DdCBEs have the general architecture of (from N- to C-terminus): COX8A MTS-3xFLAG-mitoTALE-2aa linker-DddAtox half-4aa linker-1x-UGI-ATP5B 3'UTR All left-side halves of DdCBEs have the general architecture of (from N- to C-terminus): SOD2 MTS-3xHA-mitoTALE-2aa linker-DddA$_{tox}$ half-4aa linker-1x-UGI-SOD2 3'UTR mitoTALE domains are annotated as: bold for N-terminal domain, underlined for RVD and bolded italics for C-terminal domain.

[]ND6-DdCBE: Left mitoTALE-G1397-DddAtox-N-1x-UGI (Note: Terminal NG RVD recognizes a mismatched T instead of a G in the reference genome)

(SEQ ID NO: 360)

MALSRAVCGTSRQLAPVLGYLGSRQKHSLPDYPYDVPDYAGYPYDVPDYAGYPYDVP
DYAMDIADLRTLGYSQQQQEKIKPKVRSTVAQHHEALVGHGFTHAHIVALSQHPAAL
GTVAVKYQDMIAALPEATHEAIVGVGKQWSGARALEALLTVAGELRGPPLQLDTGQL
LKIAKRGGVTAVEAVHAWRNALTGAPLNLTPQQVVAIASNNGGKQALETVQRLLPVL
CQAHGLTPEQVVAIASNIGGKQALETVQALLPVLCQAHGLTPEQVVAIASHDGGKQAL
ETVQRLLPVLCQAHGLTPEQVVAIASHDGGKQALETVQRLLPVLCQAHGLTPEQVVAI
ASHDGGKQALETVQRLLPVLCQAHGLTPEQVVAIASHDGGKQALETVQRLLPVLCQA
HGLTPEQVVAIASHDGGKQALETVQRLLPVLCQAHGLTPEQVVAIASNIGGKQALETV
QALLPVLCQAHGLTPQQVVAIASNGGGKQALETVQRLLPVLCQAHGLTPQQVVAIASN
GGGRPALESIVAQLSRPDPALAALTNDHLVALACLGGRPALDAVKKGLGGSGSYALGP
YQISAPQLPAYNGQTVGTFYYVNDAGGLESKVFSSGGPTPYPNYANAGHVEGQSALFM
RDNGISEGLVFHNNPEGTCGFCVNMTETLLPENAKMTVVPPEGSGGSTNLSDIIEKETG
KQLVIQESILMLPEEVEEVIGNKPESDILVHTAYDESTDENVMLLTSDAPEYKPWALVIQ
DSNGENKIKML**

[]ND6-DdCBE: Right mitoTALE-G1397-DddAtox-N-1x-UGI (Note: Terminal NG RVD recognizes a mismatched T instead of a G in the reference genome. The NTD was also engineered to be permissive for A, T, C and G nucleotides at the N0 position)

(SEQ ID NO: 361)

MASVLTPLLLRGLTGSARRLPVPRAKIHSLDYKDHDGDYKDHDIDYKDDDDKMDIAD
LRTLGYSQQQQEKIKPKVRSTVAQHHEALVGHGFTHAHIVALSQHPAALGTVAVKYQ
DMIAALPEATHEAIVGVGKRGAGARALEALLTVAGELRGPPLQLDTGQLLKIAKRGGV
TAVEAVHAWRNALTGAPLNLTPQQVVAIASNNGGKQALETVQRLLPVLCQAHGLTPE
QVVAIASNIGGKQALETVQALLPVLCQAHGLTPQQVVAIASNGGGKQALETVQRLLPV
LCQAHGLTPQQVVAIASNNGGKQALETVQRLLPVLCQAHGLTPQQVVAIASNNGGKQ
ALETVQRLLPVLCQAHGLTPEQVVAIASHDGGKQALETVQRLLPVLCQAHGLTPQQVV
AIASNGGGKQALETVQRLLPVLCQAHGLTPEQVVAIASNIGGKQALETVQALLPVLCQ
AHGLTPQQVVAIASNGGGKQALETVQRLLPVLCQAHGLTPQQVVAIASNGGGKQALE
TVQRLLPVLCQAHGLTPQQVVAIASNGGGRPALESIVAQLSRPDPALAALTNDHLVAL
ACLGGRPALDAVKKGLGGSAIPVKRGATGETKVFTGNSNSPKSPTKGGCSGGSTNLSDI
IEKETGKQLVIQESILMLPEEVEEVIGNKPESDILVHTAYDESTDENVMLLTSDAPEYKP
WALVIQDSNGENKIKML**

[]ND1-DdCBE Right mitoTALE repeat (SEQ ID NO: 362)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR

-continued

GGVTAVEAVHAWRNALTGAPLNLTPEQVVAIASNNGGKQALETVQALLPVLCQAHGL
TPQQVVAIASNIGGKQALETVQRLLPVLCQAHGLTPQQVVAIASNNGGKQALETVQRL
LPVLCQAHGLTPEQVVAIASNGGGKQALETVQALLPVLCQAHGLTPEQVVAIASNGGG
KQALETVQALLPVLCQAHGLTPEQVVAIASNGGGKQALETVQALLPVLCQAHGLTPEQ
VVAIASNNGGKQALETVQRLLPVLCQAHGLTPEQVVAIASNIGGKQALETVQALLPVL
CQAHGLTPEQVVAIASNGGGKQALETVQRLLPVLCQAHGLTPEQVVAIASNNGGKQA
LETVQALLPVLCQAHGLTPEQVVAIASHDGGKQALETVQALLPVLCQAHGLTPEQVVA
IASNGGGKQALETVQALLPVLCQAHGLTPEQVVAIASHDGGKQALETVQRLLPVLCQA
HGLTPQQVVAIASNIGGKQALETVQRLLPVLCQAHGLTPEQVVAIASHDGGKQALETV
QALLPVLCQAHGLTPQQVVAIASHDGGKQALETVQRLLPVLCQAHGLTPQQVVAIASH
DGGKQALETVQRLLPVLCQAHGLTPQQVVAIASNGGGRPALESIVAQLSRPDPALAAL
TNDHLVALACLGGRPALDAVKKGLG

[]ND1-DdCBE Left mitoTALE repeat (SEQ ID NO: 363)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNGGGKQALETVQRLLPVLCQAHGLTPQQVVAIASNIGGKQALETVQRL
LPVLCQAHGLTPEQVVAIASNNGGKQALETVQALLPVLCQAHGLTPEQVVAIASHDGG
KQALETVQALLPVLCQAHGLTPEQVVAIASHDGGKQALETVQALLPVLCQAHGLTPEQ
VVAIASNGGGKQALETVQRLLPVLCQAHGLTPEQVVAIASNIGGKQALETVQALLPVL
CQAHGLTPEQVVAIASNNGGKQALETVQRLLPVLCQAHGLTPEQVVAIASHDGGKQA
LETVQALLPVLCQAHGLTPEQVVAIASHDGGKQALETVQALLPVLCQAHGLTPEQVVA
IASNNGGKQALETVQALLPVLCQAHGLTPEQVVAIASNGGGKQALETVQRLLPVLCQA
HGLTPQQVVAIASNGGGKQALETVQRLLPVLCQAHGLTPQQVVAIASNGGGRPALESI
VAQLSRPDPALAALTNDHLVALACLGGRPALDAVKKGLG

[]ND2-DdCBE Right mitoTALE repeat (SEQ ID NO: 364)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNIGGKQALETVQALLPVLCQAHGL
TPQQVVAIASNNGGKQALETVQRLLPVLCQAHGLTPQQVVAIASNIGGKQALETVQRL
LPVLCQAHGLTPEQVVAIASNIGGKQALETVQALLPVLCQAHGLTPEQVVAIASHDGG
KQALETVQALLPVLCQAHGLTPEQVVAIASNGGGKQALETVQALLPVLCQAHGLTPEQ
VVAIASNNGGKQALETVQRLLPVLCQAHGLTPEQVVAIASHDGGKQALETVQALLPVL
CQAHGLTPEQVVAIASNGGGKQALETVQRLLPVLCQAHGLTPEQVVAIASNIGGKQAL
ETVQALLPVLCQAHGLTPEQVVAIASNGGGKQALETVQALLPVLCQAHGLTPEQVVAI
ASNGGGKQALETVQALLPVLCQAHGLTPEQVVAIASNIGGKQALETVQRLLPVLCQAH
GLTPQQVVAIASNGGGKQALETVQRLLPVLCQAHGLTPQQVVAIASNGGGRPALESIV
AQLSRPDPALAALTNDHLVALACLGGRPALDAVKKGLG

[]ND2-DdCBE Left mitoTALE repeat (SEQ ID NO: 365)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNGGGKQALETVQRLLPVLCQAHGLTPQQVVAIASNGGGKQALETVQR
LLPVLCQAHGLTPEQVVAIASNIGGKQALETVQALLPVLCQAHGLTPEQVVAIASNNG
GKQALETVQALLPVLCQAHGLTPEQVVAIASHDGGKQALETVQALLPVLCQAHGLTPE
QVVAIASNIGGKQALETVQRLLPVLCQAHGLTPEQVVAIASNGGGKQALETVQALLPV
LCQAHGLTPEQVVAIASNIGGKQALETVQRLLPVLCQAHGLTPEQVVAIASHDGGKQA
LETVQALLPVLCQAHGLTPEQVVAIASNGGGKQALETVQALLPVLCQAHGLTPEQVVA
IASHDGGKQALETVQALLPVLCQAHGLTPEQVVAIASHDGGKQALETVQRLLPVLCQA
HGLTPQQVVAIASNGGGKQALETVQRLLPVLCQAHGLTPEQVVAIASHDGGKQALETV
QALLPVLCQAHGLTPEQVVAIASNIGGKQALETVQALLPVLCQAHGLTPEQVVAIASNI
GGKQALETVQALLPVLCQAHGLTPQQVVAIASNGGGRPALESIVAQLSRPDPALAALT
NDHLVALACLGGRPALDAVKKGLG

[]ND4-DdCBE Right mitoTALE repeat (SEQ ID NO: 366)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASHDGGKQALETVQRLLPVLCQAHGLTPQQVVAIASNGGGKQALETVQR
LLPVLCQAHGLTPEQVVAIASNNGGKQALETVQALLPVLCQAHGLTPEQVVAIASNGG
GKQALETVQALLPVLCQAHGLTPEQVVAIASNIGGKQALETVQALLPVLCQAHGLTPE
QVVAIASNIGGKQALETVQRLLPVLCQAHGLTPEQVVAIASNNGGKQALETVQALLPV
LCQAHGLTPEQVVAIASNGGGKQALETVQRLLPVLCQAHGLTPEQVVAIASNIGGKQA
LETVQRLLPVLCQAHGLTPEQVVAIASNNGGKQALETVQALLPVLCQAHGLTPEQVVA
IASNNGGKQALETVQALLPVLCQAHGLTPEQVVAIASNIGGKQALETVQALLPVLCQA
HGLTPEQVVAIASNNGGKQALETVQRLLPVLCQAHGLTPQQVVAIASNIGGKQALETV
QRLLPVLCQAHGLTPQQVVAIASNNGGKQALETVQRLLPVLCQAHGLTPQQVVAIASN
GGGRPALESIVAQLSRPDPALAALTNDHLVALACLGGRPALDAVKKGLG

[]ND4-DdCBE Left mitoTALE repeat (SEQ ID NO: 367)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNNGGKQALETVQALLPVLCQAHGL

-continued

TPQQVVAIASHDGGKQALETVQRLLPVLCQAHGLTPQQVVAIASNGGGKQALETVQR
LLPVLCQAHGLTPEQVVAIASNIGGKQALETVQALLPVLCQAHGLTPEQVVAIASNNG
GKQALETVQALLPVLCQAHGLTPEQVVAIASNGGGKQALETVQALLPVLCQAHGLTPE
QVVAIASNIGGKQALETVQRLLPVLCQAHGLTPEQVVAIASNIGGKQALETVQALLPVL
CQAHGLTPEQVVAIASHDGGKQALETVQRLLPVLCQAHGLTPEQVVAIASHDGGKQA
LETVQALLPVLCQAHGLTPEQVVAIASNIGGKQALETVQALLPVLCQAHGLTPEQVVAI
ASHDGGKQALETVQALLPVLCQAHGLTPEQVVAIASNNGGKQALETVQRLLPVLCQA
HGLTPQQVVAIASNGGGKQALETVQRLLPVLCQAHGLTPEQVVAIASNGGGKQALETV
QALLPVLCQAHGLTPEQVVAIASHDGGKQALETVQALLPVLCQAHGLTPQQVVAIASN
GGGRPALESIVAQLSRPDPALAALTNDHLVALACLGGRPALDAVKKGLG

ND5.1-DdCBE Right mitoTALE repeat (SEQ ID NO: 368)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASHDGGKQALETVQRLLPVLCQAHGL
TPEQVVAIASNGGGKQALETVQRLLPVLCQAHGLTPQQVVAIASNGGGKQALETVQRL
LPVLCQAHGLTPEQVVAIASNGGGKQALETVQALLPVLCQAHGLTPQQVVAIASNNGG
KQALETVQRLLPVLCQAHGLTPQQVVAIASNNGGKQALETVQRLLPVLCQAHGLTPEQ
VVAIASNIGGKQALETVQRLLPVLCQAHGLTPQQVVAIASNNGGKQALETVQRLLPVL
CQAHGLTPQQVVAIASNGGGKQALETVQRLLPVLCQAHGLTPEQVVAIASNIGGKQAL
ETVQRLLPVLCQAHGLTPEQVVAIASNNGGKQALETVQRLLPVLCQAHGLTPQQVVAI
ASNIGGKQALETVQRLLPVLCQAHGLTPQQVVAIASNIGGRPALESIVAQLSRPDPALA
ALTNDHLVALACLGGRPALDAVKKGLG

[]ND5.1-DdCBE Left mitoTALE repeat (SEQ ID NO: 369)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNIGGKQALETVQALLPVLCQAHGL
TPQQVVAIASNNGGKQALETVQRLLPVLCQAHGLTPQQVVAIASHDGGKQALETVQR
LLPVLCQAHGLTPEQVVAIASNIGGKQALETVQALLPVLCQAHGLTPEQVVAIASNGG
GKQALETVQALLPVLCQAHGLTPEQVVAIASNGGGKQALETVQALLPVLCQAHGLTPE
QVVAIASNIGGKQALETVQRLLPVLCQAHGLTPEQVVAIASNNGGKQALETVQALLPV
LCQAHGLTPEQVVAIASHDGGKQALETVQRLLPVLCQAHGLTPEQVVAIASNIGGKQA
LETVQALLPVLCQAHGLTPEQVVAIASNNGGKQALETVQALLPVLCQAHGLTPEQVVA
IASNNGGKQALETVQALLPVLCQAHGLTPEQVVAIASNIGGKQALETVQRLLPVLCQA
HGLTPQQVVAIASNIGGKQALETVQRLLPVLCQAHGLTPQQVVAIASNGGGRPALESIV
AQLSRPDPALAALTNDHLVALACLGGRPALDAVKKGLG

[]ND5.2-DdCBE Right mitoTALE repeat (Note: Terminal NG RVD recognizes a mismatched T instead of a G in the reference genome)

(SEQ ID NO: 370)

[]DIADLRTLGYSQQQQEKIKPKVRSTVAQHHEALVGHGFTHAHIVALSQHPAALG
TVAVKYQDMIAALPEATHEAIVGVGKQWSGARALEALLTVAGELRGPPLQLDTGQLL
KIAKRGGVTAVEAVHAWRNALTGAPLNLTPQQVVAIASNNGGKQALETVQRLLPVLC
QAHGLTPEQVVAIASHDGGKQALETVQRLLPVLCQAHGLTPQQVVAIASNGGGKQAL
ETVQRLLPVLCQAHGLTPEQVVAIASNIGGKQALETVQALLPVLCQAHGLTPQQVVAI
ASNNGGKQALETVQRLLPVLCQAHGLTPQQVVAIASNNGGKQALETVQRLLPVLCQA
HGLTPEQVVAIASHDGGKQALETVQRLLPVLCQAHGLTPQQVVAIASNGGGKQALETV
QRLLPVLCQAHGLTPQQVVAIASNNGGKQALETVQRLLPVLCQAHGLTPEQVVAIASH
DGGKQALETVQRLLPVLCQAHGLTPEQVVAIASHDGGKQALETVQRLLPVLCQAHGL
TPEQVVAIASNIGGKQALETVQALLPVLCQAHGLTPEQVVAIASNIGGKQALETVQALL
PVLCQAHGLTPQQVVAIASNGGGKQALETVQRLLPVLCQAHGLTPQQVVAIASNNGG
KQALETVQRLLPVLCQAHGLTPQQVVAIASNGGGRPALESIVAQLSRPDPALAALTND
HLVALACLGGRPALDAVKKGLG

[]ND5.2-DdCBE Left mitoTALE repeat (SEQ ID NO: 371)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNIGGKQALETVQRLLPVLCQAHGLTPQQVVAIASNIGGKQALETVQRLL
PVLCQAHGLTPEQVVAIASNIGGKQALETVQALLPVLCQAHGLTPEQVVAIASNIGGKQ
ALETVQALLPVLCQAHGLTPEQVVAIASHDGGKQALETVQALLPVLCQAHGLTPEQVV
AIASHDGGKQALETVQRLLPVLCQAHGLTPEQVVAIASNIGGKQALETVQALLPVLCQ
AHGLTPEQVVAIASNGGGKQALETVQRLLPVLCQAHGLTPEQVVAIASNIGGKQALET
VQALLPVLCQAHGLTPEQVVAIASHDGGKQALETVQALLPVLCQAHGLTPEQVVAIAS
HDGGKQALETVQALLPVLCQAHGLTPEQVVAIASNGGGKQALETVQRLLPVLCQAHG
LTPQQVVAIASHDGGKQALETVQRLLPVLCQAHGLTPQQVVAIASNGGGRPALESIVA
QLSRPDPALAALTNDHLVALACLGGRPALDAVKKGLG

[]ND5.3-DdCBE Right mitoTALE repeat (SEQ ID NO: 372)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASNIGGKQALETVQRLLPVLCQAHGL
TPEQVVAIASNIGGKQALETVQRLLPVLCQAHGLTPQQVVAIASNNGGKQALETVQRL
LPVLCQAHGLTPEQVVAIASNIGGKQALETVQALLPVLCQAHGLTPQQVVAIASNGGG
KQALETVQRLLPVLCQAHGLTPQQVVAIASNGGGKQALETVQRLLPVLCQAHGLTPEQ
VVAIASNIGGKQALETVQRLLPVLCQAHGLTPQQVVAIASNNGGKQALETVQRLLPVL

-continued

CQAHGLTPQQVVAIASNGGGKQALETVQRLLPVLCQAHGLTPEQVVAIASNIGGKQAL
ETVQRLLPVLCQAHGLTPEQVVAIASNGGGKQALETVQRLLPVLCQAHGLTPQQVVAI
ASNNGGKQALETVQRLLPVLCQAHGLTPQQVVAIASNNGGKQALETVQRLLPVLCQA
HGLTPQQVVAIASNGGGRPALESIVAQLSRPDPALAALTNDHLVALACLGGRPALDAV
KKGLG

[]ND5.3-DdCBE Left mitoTALE repeat (SEQ ID NO: 373)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNIGGKQALETVQRLLPVLCQAHGLTPQQVVAIASNNGGKQALETVQRL
LPVLCQAHGLTPEQVVAIASNGGGKQALETVQALLPVLCQAHGLTPEQVVAIASNGGG
KQALETVQALLPVLCQAHGLTPEQVVAIASHDGGKQALETVQALLPVLCQAHGLTPEQ
VVAIASNGGGKQALETVQRLLPVLCQAHGLTPEQVVAIASNGGGKQALETVQALLPVL
CQAHGLTPEQVVAIASHDGGKQALETVQRLLPVLCQAHGLTPEQVVAIASNIGGKQAL
ETVQALLPVLCQAHGLTPEQVVAIASNIGGKQALETVQALLPVLCQAHGLTPEQVVAIA
SNIGGKQALETVQALLPVLCQAHGLTPEQVVAIASNGGGKQALETVQRLLPVLCQAHG
LTPQQVVAIASNIGGKQALETVQRLLPVLCQAHGLTPQQVVAIASNGGGRPALESIVAQ
LSRPDPALAALTNDHLVALACLGGRPALDAVKKGLG

[]ATP8-DdCBE Right mitoTALE repeat (Note: Terminal NG RVD recognizes a mismatched T instead of a C in the reference genome)

(SEQ ID NO: 374)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASNIGGKQALETVQRLLPVLCQAHGL
TPEQVVAIASNGGGKQALETVQRLLPVLCQAHGLTPQQVVAIASNNGGKQALETVQRL
LPVLCQAHGLTPEQVVAIASNNGGKQALETVQALLPVLCQAHGLTPQQVVAIASNNGG
KQALETVQRLLPVLCQAHGLTPQQVVAIASHDGGKQALETVQRLLPVLCQAHGLTPEQ
VVAIASNGGGKQALETVQRLLPVLCQAHGLTPQQVVAIASNGGGKQALETVQRLLPVL
CQAHGLTPQQVVAIASNGGGKQALETVQRLLPVLCQAHGLTPEQVVAIASNNGGKQA
LETVQRLLPVLCQAHGLTPEQVVAIASNNGGKQALETVQRLLPVLCQAHGLTPQQVVA
IASNGGGRPALESIVAQLSRPDPALAALTNDHLVALACLGGRPALDAVKKGLG

ATP8-DdCBE Left mitoTALE repeat (SEQ ID NO: 375)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNIGGKQALETVQALLPVLCQAHGL
TPQQVVAIASNGGGKQALETVQRLLPVLCQAHGLTPQQVVAIASNGGGKQALETVQR
LLPVLCQAHGLTPEQVVAIASNIGGKQALETVQALLPVLCQAHGLTPEQVVAIASNIGG
KQALETVQALLPVLCQAHGLTPEQVVAIASNIGGKQALETVQALLPVLCQAHGLTPEQ
VVAIASHDGGKQALETVQRLLPVLCQAHGLTPEQVVAIASNIGGKQALETVQALLPVL
CQAHGLTPEQVVAIASHDGGKQALETVQRLLPVLCQAHGLTPEQVVAIASNIGGKQAL
ETVQALLPVLCQAHGLTPEQVVAIASNIGGKQALETVQALLPVLCQAHGLTPEQVVAIA
SNIGGKQALETVQALLPVLCQAHGLTPEQVVAIASHDGGKQALETVQRLLPVLCQAHG
LTPQQVVAIASNGGGKQALETVQRLLPVLCQAHGLTPEQVVAIASNIGGKQALETVQA
LLPVLCQAHGLTPQQVVAIASNGGGRPALESIVAQLSRPDPALAALTNDHLVALACLG
GRPALDAVKKGLG mtDNA BEs Comprising mitoZFs The mtDNA base editors described herein contemplate fusion proteins comprising a mitoZF and a DddA domain or fragment or portion thereof (e.g., an N-terminal or C-terminal fragment or portion of a DddA), and optionally the joining of the two by a linker. The application contemplates any suitable mitoZF and a DddA domain to be combined in a single fusion protein. Examples of mitoZFs and DddA domains are each defined herein.

In some embodiments, the mtDNA base editors comprise DddA domains which are DdCBE, i.e., DddA which deaminates a C. Examples of general architecture of mtDNA base editors comprising DdCBEs and mitoZFs and their amino acid and nucleotide sequences are as follows:

| | | |
|---|---|---|
| R8 v6 | MLGFVGRVAAAPASGALRRLTPS | MTS |
| | ASLPPAQLLLRAAPTAVHPVRDY | MLGFVGRVAAAPASGALRRLTPSASLP |
| | AAQDYKDDDDKVDEMTKKFGT | PAQLLLRAAPTAVHPVRDYAAQ (SEQ |
| | LTIHDTEKGSLQKKLEELELDAA | ID NO: 394) |
| | MAERPFQCDICMRNFSTSGSLSR | FLAG tag |
| | HIRTHTGEKPFQCDICMRNFSQSG | DYKDDDDK (SEQ ID NO: 395) |
| | SLTRHIRTHTGSEKPFQCDICMRN | NES |
| | FSRSDALSQHIRTHTGEKPFQCDI | VDEMTKKFGTLTIHDTEK (SEQ ID NO: |
| | CMRNFSRNDNRITHIRTHTGEKPF | 396) |
| | QCDICMRNFSRSDHLTQHTKIHL | Linker |
| | RGSGGGGSGGSGGSGSYALGPY | GS |
| | QISAPQLPAYNGQTVGTFYYVND | NES2 |
| | AGGLESKVFSSGGPTPYPNYANA | LQKKLEELELD (SEQ ID NO: 397) |
| | GHVEGQSALFMRDNGISEGLVFH | Linker |
| | NNPEGTCGFCVNMTETLLPENAK | AA |
| | MTVVPPEGSGGSTNLSDIIEKETG | ZF (R8) |
| | KQLVIQESILMLPEEVEEVIGNKP | MAERPFQCDICMRNFSTSGSLSRHIRTH |
| | ESDILVHTAYDESTDENVMLLTS | TGEKPFQCDICMRNFSQSGSLTRHIRTH |

-continued

| | | |
|---|---|---|
| | DAPEYKPWALVIQDSNGENKIKM<br>LGSGATNFSLLKQAGDVEENPGP<br>MASVLTPLLLRGLTGSARRLPVP<br>RAKIHSLGSTNLSDIIEKETGKQL<br>VIQESILMLPEEVEEVIGNKPESDI<br>LVHTAYDESTDENVMLLTSDAPE<br>YKPWALVIQDSNGENKIKML<br>(SEQ ID NO: 382) | TGSEKPFQCDICMRNFSRSDALSQHIRT<br>HTGEKPFQCDICMRNFSRNDNRITHIRT<br>HTGEKPFQCDICMRNFSRSDHLTQHTKI<br>HLR (SEQ ID NO: 398)<br>Linker<br>GSGGGGSGGSGGS (SEQ ID NO: 399)<br>Split DddA (DddA-G1397N)<br>GSYALGPYQISAPQLPAYNGQTVGTFY<br>YVNDAGGLESKVFSSGGPTPYPNYANA<br>GHVEGQSALFMRDNGISEGLVFHNNPE<br>GTCGFCVNMTETLLPENAKMTVVPPE<br>G (SEQ ID NO: 284)<br>Linker<br>SGGS (SEQ ID NO: 348)<br>UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341)<br>Linker<br>GSG<br>P2A Peptide<br>ATNFSLLKQAGDVEENPGP (SEQ ID<br>NO: 400)<br>MTS<br>MASVLTPLLLRGLTGSARRLPVPRAKI<br>HSL (SEQ ID NO: 401)<br>Linker<br>GS<br>UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341) |
| 5xZnF-<br>4-R8 v6 | MLGFVGRVAAAPASGALRRLTPS<br>ASLPPAQLLLRAAPTAVHPVRDY<br>AAQDYKDDDDKVDEMTKKFGT<br>LTIHDTEKGSLQKKLEELELDAA<br>MAERPFQCDICMRNFSQASNLIS<br>HIRTHTGEKPFQCDICMRNFSTSH<br>SLTEHIRTHTGSEKPFQCDICMRN<br>FSERSHLREHIRTHTGEKPFQCDI<br>CMRNFSQSGNLTEHIRTHTGEKP<br>FQCDICMRNFSSKKALTEHTKIHL<br>RGSGGGGSGGSGGSAIPVKRGAT<br>GETKVFTGNSNSPKSPTKGGCSG<br>GSTNLSDIIEKETGKQLVIQESILM<br>LPEEVEEVIGNKPESDILVHTAYD<br>ESTDENVMLLTSDAPEYKPWAL<br>VIQDSNGENKIKMLGSGATNESL<br>LKQAGDVEENPGPMASVLTPLLL<br>RGLTGSARRLPVPRAKIHSLGSTN<br>LSDIIEKETGKQLVIQESILMLPEE<br>VEEVIGNKPESDILVHTAYDESTD<br>ENVMLLTSDAPEYKPWALVIQDS<br>NGENKIKML (SEQ ID NO: 383) | MTS<br>MLGFVGRVAAAPASGALRRLTPSASLP<br>PAQLLLRAAPTAVHPVRDYAAQ (SEQ<br>ID NO: 394)<br>FLAG tag<br>DYKDDDDK (SEQ ID NO: 395)<br>NES<br>VDEMTKKFGTLTIHDTEK (SEQ ID NO:<br>396)<br>Linker<br>GS<br>NES2<br>LQKKLEELELD (SEQ ID NO: 397)<br>Linker<br>AA<br>ZF (5xZnF-4-R8)<br>MAERPFQCDICMRNFSQASNLISHIRTH<br>TGEKPFQCDICMRNFSTSHSLTEHIRTH<br>TGSEKPFQCDICMRNFSERSHLREHIRT<br>HTGEKPFQCDICMRNFSQSGNLTEHIRT<br>HTGEKPFQCDICMRNFSSKKALTEHTKI<br>HLR (SEQ ID NO: 402)<br>Linker<br>GSGGGGSGGSGGS (SEQ ID NO: 399)<br>Split DddA (DddA-G1397C)<br>AIPVKRGATGETKVFTGNSNSPKSPTK<br>GGC (SEQ ID NO: 286)<br>Linker<br>SGGS (SEQ ID NO: 348)<br>UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341)<br>Linker<br>GSG<br>P2A Peptide<br>ATNFSLLKQAGDVEENPGP (SEQ ID<br>NO: 400)<br>MTS<br>MASVLTPLLLRGLTGSARRLPVPRAKI<br>HSL (SEQ ID NO: 401)<br>Linker<br>GS |

-continued

| | | |
|---|---|---|
| | | UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341) |
| 5xZnF-<br>10-R8<br>v6 | MLGFVGRVAAAPASGALRRLTPS<br>ASLPPAQLLLRAAPTAVHPVRDY<br>AAQDYKDDDDKVDEMTKKFGT<br>LTIHDTEKGSLQKKLEELELDAA<br>MAERPFQCDICMRNFSQASNLIS<br>HIRTHTGEKPFQCDICMRNFSQR<br>ANLRAHIRTHTGSEKPFQCDICM<br>RNFSQASNLISHIRTHTGEKPFQC<br>DICMRNFSTSHSLTEHIRTHTGEK<br>PFQCDICMRNFSERSHLREHTKIH<br>LRGSGGGGSGGSGGSAIPVKRGA<br>TGETKVFTGNSNSPKSPTKGGCS<br>GGSTNLSDIIEKETGKQLVIQESIL<br>MLPEEVEEVIGNKPESDILVHTAY<br>DESTDENVMLLTSDAPEYKPWA<br>LVIQDSNGENKIKMLGSGATNFS<br>LLKQAGDVEENPGPMASVLTPLL<br>LRGLTGSARRLPVPRAKIHSLGST<br>NLSDIIEKETGKQLVIQESILMLPE<br>EVEEVIGNKPESDILVHTAYDEST<br>DENVMLLTSDAPEYKPWALVIQ<br>DSNGENKIKML (SEQ ID NO: 384) | MTS<br>MLGFVGRVAAAPASGALRRLTPSASLP<br>PAQLLLRAAPTAVHPVRDYAAQ (SEQ<br>ID NO: 394)<br>FLAG tag<br>DYKDDDDK (SEQ ID NO: 395)<br>NES<br>VDEMTKKFGTLTIHDTEK (SEQ ID NO:<br>396)<br>Linker<br>GS<br>NES2<br>Linker<br>LQKKLEELELD (SEQ ID NO: 397)<br>AA<br>ZF (5xZnF-10-R8)<br>MAERPFQCDICMRNFSQASNLISHIRTH<br>TGEKPFQCDICMRNFSQRANLRAHIRT<br>HTGSEKPFQCDICMRNFSQASNLISHIR<br>THTGEKPFQCDICMRNFSTSHSLTEHIR<br>THTGEKPFQCDICMRNFSERSHLREHT<br>KIHLR (SEQ ID NO: 403)<br>Linker<br>GSGGGGSGGSGGS (SEQ ID NO: 399)<br>Split DddA (DddA-G1397C)<br>AIPVKRGATGETKVFTGNSNSPKSPTK<br>GGC (SEQ ID NO: 286)<br>Linker<br>SGGS (SEQ ID NO: 348)<br>UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341)<br>Linker<br>GSG<br>P2A Peptide<br>ATNFSLLKQAGDVEENPGP (SEQ ID<br>NO: 400)<br>MTS<br>MASVLTPLLLRGLTGSARRLPVPRAKI<br>HSL (SEQ ID NO: 401)<br>Linker<br>GS<br>UGI<br>TNLSDIIEKETGKQLVIQESILMLPEEVE<br>EVIGNKPESDILVHTAYDESTDENVML<br>LTSDAPEYKPWALVIQDSNGENKIKML<br>(SEQ ID NO: 341) |
| R13-1<br>v6 | MLGFVGRVAAAPASGALRRLTPS<br>ASLPPAQLLLRAAPTAVHPVRDY<br>AAQDYKDDDDKVDEMTKKFGT<br>LTIHDTEKGSLQKKLEELELDAA<br>MAERPFQCDICMRNFSRSDNLST<br>HIRTHTGEKPFQCDICMRNFSDRS<br>DLSRHIRTHTGEKPFQCDICMRNF<br>SQSGDLTRHIRTHTGSEKPFQCDI<br>CMRNFSRSDSLSAHIRTHTGEKPF<br>QCDICMRNFSQKATRITHTKIHLR<br>GSGGGGSGGSGGSGSYALGPYQI<br>SAPQLPAYNGQTVGTFYYVNDA<br>GGLESKVFSSGGPTPYPNYANAG<br>HVEGQSALFMRDNGISEGLVFHN<br>NPEGTCGFCVNMTETLLPENAK<br>MTVVPPEGSGGSTNLSDIIEKETG<br>KQLVIQESILMLPEEVEEVIGNKP<br>ESDILVHTAYDESTDENVMLLTS<br>DAPEYKPWALVIQDSNGENKIKM<br>LGSGATNFSLLKQAGDVEENPGP<br>MASVLTPLLLRGLTGSARRLPVP<br>RAKIHSLGSTNLSDIIEKETGKQL | MTS<br>MLGFVGRVAAAPASGALRRLTPSASLP<br>PAQLLLRAAPTAVHPVRDYAAQ (SEQ<br>ID NO: 394)<br>FLAG tag<br>DYKDDDDK (SEQ ID NO: 395)<br>NES<br>VDEMTKKFGTLTIHDTEK (SEQ ID NO:<br>396)<br>Linker<br>GS<br>NES2<br>LQKKLEELELD (SEQ ID NO: 397)<br>Linker<br>AA<br>ZF (R13-1)<br>MAERPFQCDICMRNFSRSDNLSTHIRTH<br>TGEKPFQCDICMRNFSDRSDLSRHIRTH<br>TGEKPFQCDICMRNFSQSGDLTRHIRTH<br>TGSEKPFQCDICMRNFSRSDSLSAHIRT<br>HTGEKPFQCDICMRNFSQKATRITHTKI<br>HLR (SEQ ID NO: 404) |

-continued

| | | |
|---|---|---|
| | VIQESILMLPEEVEEVIGNKPESDI LVHTAYDESTDENVMLLTSDAPE YKPWALVIQDSNGENKIKML (SEQ ID NO: 385) | Linker<br>GSGGGGSGGSGGS (SEQ ID NO: 399)<br>Split DddA (DddA-G1397N)<br>GSYALGPYQISAPQLPAYNGQTVGTFY YVNDAGGLESKVFSSGGPTPYPNYANA GHVEGQSALFMRDNGISEGLVFHNNPE GTCGFCVNMTETLLPENAKMTVVPPE G (SEQ ID NO: 284)<br>Linker<br>SGGS (SEQ ID NO: 348)<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKI HSL (SEQ ID NO: 401)<br>Linker<br>GS<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-9-R13 v6 | MLGFVGRVAAAPASGALRRLTPS ASLPPAQLLLRAAPTAVHPVRDY AAQDYKDDDDKVDEMTKKFGT LTIHDTEKGSLQKKLEELELDAA MAERPFQCDICMRNFSQSSSLVR HIRTHTGEKPFQCDICMRNFSRSD NLVRHIRTHTGSEKPFQCDICMR NFSQAGHLASHIRTHTGEKPFQC DICMRNFSRKDNLKNHIRTHTGE KPFQCDICMRNFSRKDALRGHTK IHLRGSGGGGSGGSGGSAIPVKR GATGETKVFTGNSNSPKSPTKGG CSGGSTNLSDIIEKETGKQLVIQES ILMLPEEVEEVIGNKPESDILVHT AYDESTDENVMLLTSDAPEYKP WALVIQDSNGENKIKMLGSGAT NFSLLKQAGDVEENPGPMASVLT PLLLRGLTGSARRLPVPRAKIHSL GSTNLSDIIEKETGKQLVIQESILM LPEEVEEVIGNKPESDILVHTAYD ESTDENVMLLTSDAPEYKPWAL VIQDSNGENKIKML (SEQ ID NO: 386) | MTS<br>MLGFVGRVAAAPASGALRRLTPSASLP PAQLLLRAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LQKKLEELELD (SEQ ID NO: 397)<br>Linker<br>AA<br>ZF (5xZnF-9-R13)<br>MAERPFQCDICMRNFSQSSSLVRHIRTH TGEKPFQCDICMRNFSRSDNLVRHIRTH TGSEKPFQCDICMRNFSQAGHLASHIRT HTGEKPFQCDICMRNFSRKDNLKNHIR THTGEKPFQCDICMRNFSRKDALRGHT KIHLR (SEQ ID NO: 405)<br>Linker<br>GSGGGGSGGSGGS (SEQ ID NO: 399)<br>Split DddA (DddA-G1397C)<br>AIPVKRGATGETKVFTGNSNSPKSPTK GGC (SEQ ID NO: 286)<br>Linker<br>SGGS (SEQ ID NO: 348)<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKI HSL (SEQ ID NO: 401)<br>Linker<br>GS<br>UGI |

-continued

| | | |
|---|---|---|
| | | TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-12-R13 v6 | MLGFVGRVAAAPASGALRRLTPS ASLPPAQLLLRAAPTAVHPVRDY AAQDYKDDDDKVDEMTKKFGT LTIHDTEKGSLQKKLEELELDAA MAERPFQCDICMRNFSRSDHLTT HIRTHTGEKPFQCDICMRNFSQSS SLVRHIRTHTGSEKPFQCDICMRN FSRSDNLVRHIRTHTGEKPFQCDI CMRNFSQAGHLASHIRTHTGEKP FQCDICMRNFSRKDNLKNHTKIH LRGSGGGGSGGSGGSAIPVKRGA TGETKVFTGNSNSPKSPTKGGCS GGSTNLSDIIEKETGKQLVIQESIL MLPEEVEEVIGNKPESDILVHTAY DESTDENVMLLTSDAPEYKPWA LVIQDSNGENKIKMLGSGATNFS LLKQAGDVEENPGPMASVLTPLL LRGLTGSARRLPVPRAKIHSLGST NLSDIIEKETGKQLVIQESILMLPE EVEEVIGNKPESDILVHTAYDEST DENVMLLTSDAPEYKPWALVIQ DSNGENKIKML (SEQ ID NO: 387) | MTS<br>MLGFVGRVAAAPASGALRRLTPSASLP PAQLLLRAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LQKKLEELELD (SEQ ID NO: 397)<br>Linker<br>AA<br>ZF (5xZnF-12-R13)<br>MAERPFQCDICMRNFSRSDHLTTHIRT HTGEKPFQCDICMRNFSQSSSLVRHIRT HTGSEKPFQCDICMRNFSRSDNL VRHIR THTGEKPFQCDICMRNFSQAGHLASHI RTHTGEKPFQCDICMRNFSRKDNLKNH TKIHLR (SEQ ID NO: 406)<br>Linker<br>GSGGGGSGGSGGS (SEQ ID NO: 399)<br>Split DddA (DddA-G1397C)<br>AIPVKRGATGETKVFTGNSNSPKSPTK GGC (SEQ ID NO: 286)<br>Linker<br>SGGS (SEQ ID NO: 348)<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKI HSL (SEQ ID NO: 401)<br>Linker<br>GS<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341) |
| R8 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR NFSTSGSLSRHIRTHTGEKPFACDI CGRKFAQSGSLTRHTKIHTGGQR PFQCRICMRNFSRSDALSQHIRTH TGEKPFACDICGRKFARNDNRIT HTKIHTGEKPFQCRICMRKFARS DHLTQHTKIHLRGSGGGGSGGSG GSGSYALGPYQISAPQLPAYNGQ TVGTFYYVNDAGGLESKVFSSGG PTPYPNYANAGHVEGQSALFMR DNGISEGLVFHNNPEGTCGFCVN MTETLLPENAKMTVVPPEGSGGS TNLSDIIEKETGKQLVIQESILMLP EEVEEVIGNKPESDILVHTAYDES TDENVMLLTSDAPEYKPWALVIQ DSNGENKIKML (SEQ ID NO: 388) | MTS<br>MLGFVGRVAAAPASGALRRLTPSASLP PAQLLLRAAPTAVHPVRDYAAQ (SEQ ID NO: 394)<br>FLAG tag<br>DYKDDDDK (SEQ ID NO: 395)<br>NES<br>ZF (R8)<br>VDEMTKKFGTLTIHDTEK (SEQ ID NO: 396)<br>Linker<br>AA<br>MAERPFQCRICMRNFSTSGSLSRHIRTH TGEKPFACDICGRKFAQSGSLTRHTKIH TGGQRPFQCRICMRNFSRSDALSQHIRT HTGEKPFACDICGRKFARNDNRITHTKI HTGEKPFQCRICMRKFARSDHLTQHTK IHLR (SEQ ID NO: 407)<br>Linker<br>GSGGGGSGGSGGS (SEQ ID NO: 399)<br>Split DddA (DddA-G1397N)<br>GSYALGPYQISAPQLPAYNGQTVGTFY YVNDAGGLESKVFSSGGPTPYPNYANA GHVEGQSALFMRDNGISEGLVFHNNPE |

| | | |
|---|---|---|
| | | GTCGFCVNMTETLLPENAKMTVVPPE G (SEQ ID NO: 284) Linker SGGS (SEQ ID NO: 348) UGI TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-4-R8 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR NFSQASNLISHIRTHTGEKPFACDI CGRKFATSHSLTEHTKIHTGSQKP FQCRICMRNFSERSHLREHIRTHT GEKPFACDICGRKFAQSGNLTEH TKIHTGEKPFQCRICMRKFASKK ALTEHTKIHLRGSGGGGSGGSGG SAIPVKRGATGETKVFTGNSNSP KSPTKGGCSGGSTNLSDIIEKETG KQLVIQESILMLPEEVEEVIGNKP ESDILVHTAYDESTDENVMLLTS DAPEYKPWALVIQDSNGENKIKM L (SEQ ID NO: 389) | MTS MLGFVGRVAAAPASGALRRLTPSASLP PAQLLLRAAPTAVHPVRDYAAQ (SEQ ID NO: 394) FLAG tag DYKDDDDK (SEQ ID NO: 395) NES VDEMTKKFGTLTIHDTEK (SEQ ID NO: 396) Linker AA ZF (5xZnF-4-R8) MAERPFQCRICMRNFSQASNLISHIRTH TGEKPFACDICGRKFATSHSLTEHTKIH TGSQKPFQCRICMRNFSERSHLREHIRT HTGEKPFACDICGRKFAQSGNLTEHTKI HTGEKPFQCRICMRKFASKKALTEHTK IHLR (SEQ ID NO: 408) Linker GSGGGGSGGSGGS (SEQ ID NO: 399) Split DddA (DddA-G1397C) AIPVKRGATGETKVFTGNSNSPKSPTK GGC (SEQ ID NO: 286) Linker SGGS (SEQ ID NO: 348) UGI TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-10-R8 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR NFSQASNLISHIRTHTGEKPFACDI CGRKFAQRANLRAHTKIHTGSQK PFQCRICMRNFSQASNLISHIRTH TGEKPFACDICGRKFATSHSLTEH TKIHTGEKPFQCRICMRKFAERSH LREHTKIHLRGSGGGGSGGSGGS AIPVKRGATGETKVFTGNSNSPK SPTKGGCSGGSTNLSDIIEKETGK QLVIQESILMLPEEVEEVIGNKPES DILVHTAYDESTDENVMLLTSDA PEYKPWALVIQDSNGENKIKML (SEQ ID NO: 390) | MTS MLGFVGRVAAAPASGALRRLTPSASLP PAQLLLRAAPTAVHPVRDYAAQ (SEQ ID NO: 394) FLAG tag DYKDDDDK (SEQ ID NO: 395) NES VDEMTKKFGTLTIHDTEK (SEQ ID NO: 396) Linker AA ZF (5xZnF-10-R8) MAERPFQCRICMRNFSQASNLISHIRTH TGEKPFACDICGRKFAQRANLRAHTKI HTGSQKPFQCRICMRNFSQASNLISHIR THTGEKPFACDICGRKFATSHSLTEHTK IHTGEKPFQCRICMRKFAERSHLREHTK IHLR (SEQ ID NO: 409) Linker GSGGGGSGGSGGS (SEQ ID NO: 399) Split DddA (DddA-G1397C) AIPVKRGATGETKVFTGNSNSPKSPTK GGC (SEQ ID NO: 286) Linker SGGS (SEQ ID NO: 348) UGI TNLSDIIEKETGKQLVIQESILMLPEEVE EVIGNKPESDILVHTAYDESTDENVML LTSDAPEYKPWALVIQDSNGENKIKML (SEQ ID NO: 341) |
| R13-1 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR | MTS MLGFVGRVAAAPASGALRRLTPSASLP PAQLLLRAAPTAVHPVRDYAAQ (SEQ ID NO: 394) |

-continued

| | | |
|---|---|---|
| | NFSRSDNLSTHIRTHTGEKPFACD ICGRKFADRSDLSRHTKIHTGEKP FQCRICMRKFAQSGDLTRHTKIH TGSQKPFQCRICMRNFSRSDSLSA HIRTHTGEKPFACDICGRKFAQK ATRITHTKIHLRGSGGGGSGGSG GSGSYALGPYQISAPQLPAYNGQ TVGTFYYVNDAGGLESKVFSSGG PTPYPNYANAGHVEGQSALFMR DNGISEGLVFHNNPEGTCGFCVN MTETLLPENAKMTVVPPEGSGGS TNLSDIIEKETGKQLVIQESILMLP EEVEEVIGNKPESDILVHTAYDES TDENVMLLTSDAPEYKPWALVIQ DSNGENKIKML (SEQ ID NO: 391) | FLAG tag<br>DYKDDDDK (SEQ ID NO: 395)<br>NES<br>VDEMTKKFGTLTIHDTEK (SEQ ID NO: 396)<br>Linker<br>AA<br>ZF (R13-1)<br>MAERPFQCRICMRNFSRSDNLSTHIRTH TGEKPFACDICGRKFADRSDLSRHTKIH TGEKPFQCRICMRKFAQSGDLTRHTKI HTGSQKPFQCRICMRNFSRSDSLSAHIR THTGEKPFACDICGRKFAQKATRITHT KIHLR (SEQ ID NO: 410)<br>Linker<br>GSGGGGSGGSGGS (SEQ ID NO: 399)<br>Split DddA (DddA-G1397N)<br>GSYALGPYQISAPQLPAYNGQTVGTFY YVNDAGGLESKVFSSGGPTPYPNYANA GHVEGQSALFMRDNGISEGLVFHNNPE GTCGFCVNMTETLLPENAKMTVVPPE G (SEQ ID NO: 284)<br>Linker<br>SGGS (SEQ ID NO: 348)<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-9-R13 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR NFSQSSSLVRHIRTHTGEKPFACD ICGRKFARSDNLVRHTKIHTGSQ KPFQCRICMRNFSQAGHLASHIR THTGEKPFACDICGRKFARKDNL KNHTKIHTGEKPFQCRICMRKFA RKDALRGHTKIHLRGSGGGGSGG SGGSAIPVKRGATGETKVFTGNS NSPKSPTKGGCSGGSTNLSDIIEK ETGKQLVIQESILMLPEEVEEVIG NKPESDILVHTAYDESTDENVML LTSDAPEYKPWALVIQDSNGENK IKML (SEQ ID NO: 392) | MTS<br>MLGFVGRVAAAPASGALRRLTPSASLP PAQLLLRAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-9-R13)<br>MAERPFQCRICMRNFSQSSSLVRHIRTH TGEKPFACDICGRKFARSDNLVRHTKI HTGSQKPFQCRICMRNFSQAGHLASHI RTHTGEKPFACDICGRKFARKDNLKNH TKIHTGEKPFQCRICMRKFARKDALRG HTKIHLR (SEQ ID NO: 411)<br>Linker<br>GSGGGGSGGSGGS (SEQ ID NO: 399)<br>Split DddA (DddA-G1397C)<br>AIPVKRGATGETKVFTGNSNSPKSPTK GGC (SEQ ID NO: 286)<br>Linker<br>SGGS (SEQ ID NO: 348)<br>UGI<br>TNLSDIIEKETGKQLVIQESILMLPEEVE EVIGNKPESDILVHTAYDESTDENVML LTSDAPEYKPWALVIQDSNGENKIKML (SEQ ID NO: 341) |
| 5xZnF-12-R13 v3 | MLGFVGRVAAAPASGALRRLTPS ASLPPAQLLLRAAPTAVHPVRDY AAQDYKDDDDKVDEMTKKFGT LTIHDTEKAAMAERPFQCRICMR NFSRSDHLTTHIRTHTGEKPFACD ICGRKFAQSSSLVRHTKIHTGSQK PFQCRICMRNFSRSDNLVRHIRTH TGEKPFACDICGRKFAQAGHLAS HTKIHTGEKPFQCRICMRKFARK DNLKNHTKIHLRGSGGGGSGGSG GSAIPVKRGATGETKVFTGNSNS PKSPTKGGCSGGSTNLSDIIEKET GKQLVIQESILMLPEEVEEVIGNK PESDILVHTAYDESTDENVMLLT SDAPEYKPWALVIQDSNGENKIK ML (SEQ ID NO: 393) | MTS<br>MLGFVGRVAAAPASGALRRLTPSASLP PAQLLLRAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-12-R13)<br>MAERPFQCRICMRNFSRSDHLTTHIRTH TGEKPFACDICGRKFAQSSSLVRHTKIH TGSQKPFQCRICMRNFSRSDNLVRHIRT HTGEKPFACDICGRKFAQAGHLASHTK IHTGEKPFQCRICMRKFARKDNLKNHT KIHLR (SEQ ID NO: 412) |

-continued

```
Linker
GSGGGGSGGSGGS (SEQ ID NO: 399)
Split DddA (DddA-G1397C)
AIPVKRGATGETKVFTGNSNSPKSPTK
GGC (SEQ ID NO:286)
Linker
SGGS (SEQ ID NO: 348)
UGI
TNLSDIIEKETGKQLVIQESILMLPEEVE
EVIGNKPESDILVHTAYDESTDENVML
LTSDAPEYKPWALVIQDSNGENKIKML
(SEQ ID NO: 341)
```

DddAs

In various embodiments, the mtDNA base editors or the polypeptides that comprise the mtDNA base editor % (e.g., the pDNAbps and DddA) may be engineered to include a DddA, or an inactive fragment thereof.

In various embodiments, the DddA protein has the following amino acid sequence:

GSYALGPYQISAPQLPAYNGQTVGTFYYVNDAG-GLESKVFSSGGPTPYPNYAN AGHVEG-QSALFMRDNGISEGLVFHNNPEGTCGFCVNMTETLL-PENAKMTVVPPEGAIP VKRGATGETKVFTGNSNSPKSPTKGGC (SEQ IN NO: 338), or an amino acid sequence having at least 70%, at least 75%, at least 80%, at least 85%, at least 90%, at least 95%, at least 96%, at least 97%, at least 98%, at least 99%, or 100% sequence identify with DddA of SEQ ID NO: 338, or a fragment thereof.

This full length DddA may also be referred to as "DddA-$_{tox}$" since it is toxic to cells, as described in Example 1.

In other embodiments, the DddA has the following amino acid sequence: XGSSHHHHHHSQDPIGLNGG ANVYHY-APNP VGWVDPWGLA GSYALGPYQI SAPQLPAYN-GQTVGTFYYVN DAGGLESKVF SSGGPTPYPN YANAGHVEGQ SALFXRDNGI SEGLVFHNNPEGTCGFCVNX TETLLPENAK XTVVPPEGAI PVKRGATGET KVFTGNSNSPK-SPTKGGC (SEQ ID NO: 413) (which corresponds to PDB Accession No. 6U08_A of *Burkholderia cenocepacia*), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of 6U08_A (SEQ ID NO: 413).

In various other embodiments, a split DddA can have the following sequences:

G1333 DddAtox-N¬GSYALGPYQISAPQLPAYN-GQTVGTFYYVNDAGGLESKVFSSGG (SEQ ID NO: 349), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of SEQ ID NO: 349.

G1333 DddAtox-C PTPYPNYANAGHVEG-QSALFMRDNGISEGLVFHNNPEGTCGFCVNMTETLL-PENAKMT VVPPEGAIPVKRGATGETKVFTGNSNSPK-SPTKGGC (SEQ ID NO: 350), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of SEQ ID NO: 350.

G1397 DddAtox-N¬GSYALGPYQISAPQLPAYNGQ TVGTFYYVNDAG-GLESKVFSSGGPTPYPNYANAGHVE GQSALFMRDNG-ISEGLVFHNNPEGTCGFCVNMTETLL-PENAKMTVVPPEG (SEQ ID NO: 351), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of SEQ ID NO: 351.

G1397 DddAtox-C AIPVKRGATGETKVFTGNSNSPK-SPTKGGC (SEQ ID NO: 352), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of SEQ ID NO: 352.

Split DddA (DddA-G1397N) GSYALGPYQISAPQL-PAYNGQTVGTFYYVNDAG-GLESKVFSSGGPTPYPNYANAGHVE GQSALFMRDNG-ISEGLVFHNNPEGTCGFCVNMTETLL-PENAKMTVVPPEG (SEQ ID NO: 351), and can include fragments or variants thereof, including amino acid sequences having at least 70%, at least 75%, at least 80%, at least 85%, at least 90%, at least 95%, at least 96%, at least 97%, at least 98%, at least 99%, or 100% sequence identify with DddA of SEQ ID NO: 351.

```
Split DddA (DddA-G1397C)
                                    (SEQ ID NO: 352)
AIPVKRGATGETKVFTGNSNSPKSPTKGGC.
```

The disclosure also contemplates the use of any variant of DddAtox, or proteins comprising an amino acid sequence having at least 70%, at least 75%, at least 80%, at least 85%, at least 90%, at least 95%, at least 96%, at least 97%, at least 98%, at least 99%, or 100% sequence identify with DddA-G1397C, or a biologically active fragment of DddA-G1397C.

As shown in FIG. 1A, the present inventors have recognized that the whole, intact DddA is toxic to cells. Thus, in order to utilize the DddA in the context of the mtDNA base editors described herein, the DddA must be delivered in an inactive form. One of ordinary skill in the art will appreciate that various methods, techniques, and modification known in the art can be adapted for reversibly inactivating DddA such that the enzyme may be delivered to a cell in an inactive state, but then become activated inside the cell (or the mitochondria) under one or more conditions, or in the presence of one or more inducing agents, in order to conduct the desired deamination.

In preferred embodiments, as depicted in FIGS. 1A-1F, the DddA may be split into inactive fragments which can be separately delivered to a target deamination site on separate fusion constructs that target each fragment of the DddA to sites positioned on either side of a target edit site.

In some embodiments, the DddA comprises a first portion and a second portion. In some embodiments, the first portion and the second portion together comprise a full length DddA. In some embodiments, the first and second portion comprise less than the full length DddA portion. In some embodiments, the first and second portion independently do not have any, or have minimal, native DddA activity (e.g., deamination activity). In some embodiment, the first and second portion can re-assemble (i.e., dimerize) into a DddA protein with, at least partial, native DddA activity (e.g., deamination activity).

In some embodiments, the first and second portion of the DddA are formed by truncating (i.e., dividing or splitting the DddA protein) at specified amino acid residues. In some embodiments, the first portion of a DddA comprises a full-length DddA truncated at its N-terminus. In some embodiments, the second portion of a DddA comprises a full-length DddA truncated at its C-terminus. In some embodiments, additional truncations are performed to either the full-length DddA or to the first or second portions of the DddA. In some embodiments, the first and second portions of a DddA may comprise additional truncations, but which the first and second portion can dimerize or re-assemble, to restore, at least partially, native DddA activity (e.g., deamination). In some embodiments, the first and second portions comprise full-length DddA truncated at, or around, a residue in DddA selected from the group comprising: 62, 71, 73, 84, 94, 108, 110, 122, 135, 138, 148, and 155. In some embodiments, the truncation of DddA occurs at residue 148.

In certain embodiments, the DddA can be separated into two fragments by dividing the DddA at a split site. A "split site" refers to a position between two adjacent amino acids (in a wildtype DddA amino acid sequence) that marks a point of division of a DddA. In certain embodiments, the DddA can have a least one split site, such that once divided at that split site, the DddA forms an N-terminal fragment and a C-terminal fragment. The N-terminal and C-terminal fragments can be the same or difference sizes (or lengths), wherein the size and/or polypeptide length depends on the location or position of the split site. As used herein, reference to a "fragment" of DddA (or any other polypeptide) can be referred equivalently as a "portion." Thus, a DddA which is divided at a split site can form an N-terminal portion and a C-terminal portion. Preferably, the N-terminal fragment (or portion) and the C-terminal fragment (or portion) or DddA do not have a deaminase activity.

In various embodiments, a DddA may be split into two or more inactive fragments by directly cleaving the DddA at one or more split sites. Direct cleaving can be carried out by a protease (e.g., trypsin) or other enzyme or chemical reagent. In certain embodiments, such chemical cleavage reactions can be designed to be site-selective (e.g., Elashal and Raj, "Site-selective chemical cleavage of peptide bonds," *Chemical Communications,* 2016. Vol. 52, pages 6304-6307, the contents of which are incorporated herein by reference.) In other embodiments, chemical cleavage reactions can be designed to be non-selective and/or occur in a random fashion.

In other embodiments, the two or more inactive DddA fragments can be engineered as separately expressed polypeptides. For instance, for a DddA having one split site, the N-terminal DddA fragment could be engineered from a first nucleotide sequence that encodes the N-terminal DddA fragment (which extends from the N-terminus of the DddA up to and including the residue on the amino-terminal side of the split site). In such an example, the C-terminal DddA fragment could be engineered from a second nucleotide sequence that encodes the C-terminal DddA fragment (which extends from the carboxy-terminus of the split site up to including the natural C-terminus of the DddA protein). The first and second nucleotide sequences could be on the same or different nucleotide molecules (e.g., the same or different expression vectors).

In various embodiments, that N-terminal portion of the DddA may be referred to as "DddA-N half" and the C-terminal portion of the DddA may be referred to as the "DddA-C half." Reference to the term "half" does not connote the requirement that the DddA-N and DddA-C portions are identically half of the size and/or sequence length of a complete DddA, or that the split site is required to be at the mid point of the complete DddA polypeptide. To the contrary, and as noted above, the split site can be between any pair of residues in the DddA polypeptide, thereby giving rise to half portions which are unequal in size and/or sequence length. In certain embodiments, the split site is within a loop region of the DddA.

Accordingly, in one aspect, the disclosure relates to a pair of fusion proteins useful for making modifications to the sequence of mitochondrial DNA (e.g., mtDNA). The pair of fusion proteins, in some embodiments, can comprise a first fusion protein comprising a first pDNAbp (e.g., a mitoTALE, mitoZFP, or a CRISPR/Cas9) and a first portion or fragment of a DddA, and a second fusion protein comprising a second pDNAbp (e.g., mitoTALE, mitoZFP, or a CRISPR/Cas9) and a second portion or fragment of a DddA, such that the first and the second portions of the DddA reconstitute a DddA upon co-localization in a cell and/or mitochondria. In certain embodiments, that first portion of the DddA is an N-terminal fragment of a DddA and the second portion of the DddA is C-terminal fragment of a DddA. In other embodiments, the first portion of the DddA is a C-terminal fragment of a DddA and the second portion of the DddA is an N-terminal fragment of a DddA. In this aspect, the structure of the pair of fusion proteins can be, for example:

[pDNAbp]-[DddA half$^A$] and [pDNAbp]-[DddA half$^B$];

[DddA-half$^A$]-[pDNAbp] and [DddA-half$^B$]-[pDNAbp];

[pDNAbp]-[DddA half$^A$] and [DddA-half$^B$]-[pDNAbp]; or

[DddA-half$^A$]-[pDNAbp] and [pDNAbp]-[DddA half$^B$], wherein "A" or "B" can be the N-terminal or C-terminal half of DddA.

In another aspect, the disclosure relates to a pair of fusion proteins useful for making modifications to the sequence of mitochondrial DNA (e.g., mtDNA). The pair of fusion proteins can comprise a first fusion protein comprising a first mitoTALE and a first portion or fragment of a DddA, and a second fusion protein comprising a second mitoTALE and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoTALE]-[DddA half$^{A}$] and [mitoTALE]-[DddA half$^{B}$].

[DddA-half$^{A}$]-[pDNAbp] and [DddA-half$^{B}$]-[mitoTALE];

[mitoTALE]-[DddA half$^{A}$] and [DddA-half$^{B}$]-[mitoTALE]; or

[DddA-half$^{A}$]-[mitoTALE] and [mitoTALE]-[DddA half$^{B}$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first mitoZFP and a first portion or fragment of a DddA, and a second fusion protein comprising a second mitoZFP and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA and the second portion of the DddA is C-terminal fragment of a Ddda. In other embodiments, the first portion of the DddA is a C-terminal fragment of a DddA and the second portion of the DddA is an N-terminal fragment of a DddA. In this aspect, the structure of the pair of fusion proteins can be, for example:

[mitoZFP]-[DddA half$^{A}$] and [mitoZFP]-[DddA half$^{B}$];

[DddA-half$^{A}$]-[pDNAbp] and [DddA-half$^{B}$]-[mitoZFP];

[mitoZFP]-[DddA half$^{A}$] and [DddA-half$^{B}$]-[mitoZFP]: or

[DddA-half$^{A}$]-[mitoZFP] and [mitoZFP]-[DddA half$^{B}$], wherein "A" or "B" can be the N-terminal or C-terminal half of DddA.

In yet another aspect, the disclosure relates to a pair of fusion proteins useful for making modifications to the sequence of mitochondrial DNA (e.g., mtDNA). The pair of fusion proteins can comprise a first fusion protein comprising a first Cas9 and a first portion or fragment of a DddA, and a second fusion protein comprising a second Cas9 and a second portion or fragment of a DddA, such that the first and the second portions of the DddA, upon co-localization in a cell and/or mitochondria, are reconstituted an active DddA. In certain embodiments, that first portion of the DddA is an N-terminal fragment of a DddA (i.e., "DddA half$^{A}$" as shown in FIGS. 1A-1E) and the second portion of the DddA is C-terminal fragment of a DddA (i.e., "DddA half$^{B}$" as shown in FIGS. 1A-1E). In other embodiments, the first portion of the DddA is an C-terminal fragment of a DddA and the second portion of the DddA is an N-terminal fragment of a DddA. In this aspect, the structure of the pair of fusion proteins can be, for example:

[Cas9]-[DddA half$^{A}$] and [Cas9]-[DddA half$^{B}$];

[DddA-half$^{A}$]-[Cas9] and [DddA-half$^{B}$]-[Cas9];

[Cas9]-[DddA half$^{A}$] and [DddA-half$^{B}$]-[Cas9]: or

[DddA-half$^{A}$]-[Cas9] and [Cas9]-[DddA half$^{B}$], wherein "A" or "B" can be the N-terminal or C-terminal half of DddA.

In each instance above of "]-[" can be in reference to a linker sequence.

In some embodiments, a first fusion protein comprises, a first mitochondrial transcription activator-like effector (mitoTALE) domain and a first portion of a DNA deaminase effector (DddA). In some embodiments, the first portion of the DddA comprises an N-terminal truncated DddA. In some embodiments, the first mitoTALE is configured to bind a first nucleic acid sequence proximal to a target nucleotide. In some embodiments, the first portion of a DddA is linked to the remainder of the first fusion protein by the C-terminus of the first portion of a DddA.

In one aspect, the present disclosure provides mitochondrial DNA editor fusion proteins for use in editing mitochondrial DNA. As used herein, these mitochondrial DNA editor fusion proteins may be referred to as "mtDNA editors" or "mtDNA editing systems."

In various embodiments, the mtDNA editors described herein comprise (1) a programmable DNA binding protein ("pDNAbp") (e.g., a mitoTALE domain, mitoZFP domain, or a CRISPR/Cas9 domain) and a double-stranded DNA deaminase domain, which is capable of carrying out a deamination of a nucleobase at a target site associated with the binding site of the programmable DNA binding protein (pDNAbp).

In some embodiments, the double-stranded DNA deaminase is split into two inactive half portions, with each half portion being fused to a programmable DNA binding protein that binds to a nucleotide sequence either upstream or downstream of a target edit site, and wherein once in the mitochondria, the two half portions (i.e., the N-terminal half and the C-terminal half) reassociate at the target edit site by the co-localization of the programmable DNA binding proteins to binding sites upstream and downstream of the target edit site to be acted on by the DNA deaminase. The reassociation of the two half portions of the double-stranded DNA deaminase restores the deaminase activity at the target edit site. In other embodiments, the double-stranded DNA deaminase can initially be set in an inactive state which can be induced when in the mitochondria. The double-stranded DNA deaminase is preferably delivered initially in an inactive form in order to avoid toxicity inherent with the protein. Any means to regulate the toxic properties of the double-stranded DNA deaminase until such time as the activity is desired to be activated (e.g., in the mitochondria) is contemplated.

In various embodiments, the following exemplary DddA enzymes can be used with the mtDNA base editors described herein, or a sequence (amino acid or nucleotide as the case may be) having at least 70%, 75%, 80%, 85%, 90%, 95%, or 99% sequence identity with any one of the following mitoTALE sequences:

| DddA Description | DddA amino acid and/or nucleotid sequence |
|---|---|
| DddA homolog in *Burkholderia gladioli* PROTEIN | >ATF83755.1 hypothetical protein CO712_00910 [*Burkholderia gladioli* pv. *gladioli*]<br>MYEAARVTDPIEHTSALAGFLVGAVLGIALIAAVAFATFTCGFGVALL<br>AGMAAGIGAQVLLSLGESIGKMFSSQSGAITLGSPNVYVNGKQAAYA<br>TLSSVTCSKHNPTPLVAQGSTNIFINGKPAARKDDKITCGAAISDGSHD<br>TYFHGGIQTCLPIDDEVPPWLRTATDWAFALAGLVGGLGGLLKEAGG<br>LSHAVMPCAAKFIGGYVLGEAASRYVIGPAINSAIGGMFGNPVDVTT<br>GRKILPAESETDYVVPSPMPVAIRRFYSSDLDYVGTLGRGWVLPWEL<br>RLHARDGRLWYTDAQGRESGFPILKPGQAAFSEADQRYLTCTPDGRY<br>ILHDVGETYYDFGRYEPGSGRIGWVRRIEDQAGQWCQFERDSRGRVR |

-continued

| DddA Description | DddA amino acid and/or nucleotid sequence |
|---|---|
| | EIQTCGGLLAVLDYEPEHERLAEVSLVSGDQRRLVVAYGYDENGQM<br>ASVTDANGAVVRRFTYADGRMTSHSNALGFTSGYTWKVIDGTPRVV<br>ATHTSEGEAWAFEYDIEGRRTHVRHADGRHAQWRYDAQFQIVEYLD<br>FDGRRYGLKYNAAGMPVMLTLPGERTVMFEYDDAGRIVAETDPLGR<br>TTKTRYDGNSMRPVEIILPDGSAWHAEYDRQGRLLVTRDPLDRENRY<br>EYPEALSALPVAHVDALGGRKTFEWNRLGELVAYTDCSGKTTRNFF<br>DAFGLPLARENALGHRVSFDLRPTGETRRVTYPDGSSESYEYDAAGL<br>MIRHIGLGGRMQTLQRNARGQLVEAVDPAGRRTRYHYDAEGRLREL<br>QQAHARYAFAYSAGGRLVSETRPDGVLRRFEYGEAGDLAALEIVGT<br>ADDCAPNDRPVRAIRFERDRMGNLCVQHTPTEVTRYERDAGGRLLE<br>VASVPTAAGLALGIAPDTLTFEYDKAGRLSAEHGANGSVQYTLDALD<br>NVLKLALPHEQTLQMLRYGSGHVHQIRHGDQVVSDFERDDLHRELT<br>RTQGPLTERTAYDLLGRKIWQSAGFQPDALARGQGQLWRNYGYDA<br>AGELVESHDSLRGSTQFSYDPAGYLTQRVNTADRQLESFAWDAAGN<br>LLDDAQRSSRGYVEGNRLRMWQNLRFDYDAFGNLATKLRGANQRQ<br>QFTYDGQDRLVAVRTQGARGVVETRFAYDPLGRRIAKTDRTLDVRG<br>VTLREETKRFVWEGLRLAQEVRDTGVSSYVYSPDAPYMPAARVDAV<br>KAEALANAAIDKARQATRIYHFHTDVSGAPQEATNEAGDIVWAGQY<br>SAWGKVAPNQHAPARIDQPLRYAGQYADDSTELHYNTFRFYDPDVG<br>RFINQDPIGLMGGLNLYQYAPNSIAWTDWWGLAGSYTLGSYQISAPQ<br>LPAYNGQTVGTFYYVNDAGGLESRTFSSGGPTPYPNYANAGHVEGQ<br>SALFMRDNGISDGLVFHNNPEGTCGFCVNMTETLLPENSKLTVVPPE<br>GSIPVKRGATGETRTFTGNSKSPKSPVKGGC [SEQ ID NO: 130] |
| DddA homolog in *Burkholderia gladioli* DNA | >CO712_00910 NZ_CP023522.1: 185368-189645 *Burkholderia gladioli* pv. *gladioli* strain FDAARGOS_389 chromosome 1, complete sequence<br>GTGTACGAAGCGGCCCGCGTCACGGATCCGATCGAGCACACCAGC<br>GCGCTGGCCGGCTTCCTGGTGGGCGCCGTGCTCGGTATCGCCCTGA<br>TTGCTGCCGTGGCGTTCGCCACGTTCACCTGCGGCTTCGGCGTGGC<br>ACTGCTGGCCGGCATGGCGGCCGGCATCGGCGCGCAGGTGCTGTT<br>GTCGTTAGGGGAATCGATCGGGAAGATGTTCAGTTCGCAATCCGG<br>CGCGATCACGCTCGGCTCGCCGAACGTCTACGTGAACGGCAAGCA<br>GGCCGCCTACGCCACGCTCAGCAGCGTGACGTGCAGCAAGCACAA<br>CCCGACGCCGCTCGTCGCGCAGGGCTCCACCAACATCTTCATCAAC<br>GGCAAGCCGGCCGCGCGCAAGGACGACAAGATCACCTGCGGCGC<br>GGCCATCTCGGACGGCTCGCACGACACCTACTTCCACGGAGGCAT<br>CCAGACCTGCCTGCCGATCGACGACGAAGTGCCGCCGTGGCTGCG<br>CACCGCCACCGACTGGGCGTTCGCGCTGGCCGGGCTGGTGGGCGG<br>GCTCGGCGGCCTACTCAAGGAAGCGGGCGGGCTGTCGCACGCGGT<br>GATGCCGTGCGCGGCGAAGTTCATCGGCGGCTACGTGCTCGGCGA<br>GGCGGCGAGCCGCTACGTGATCGGCCCGGCCATCAACAGCGCGAT<br>CGGCGGGATGTTCGGCAACCCGGTAGACGTCACCACTGGGCGCAA<br>GATCCTCCCTGCCGAATCGGAAACCGATTACGTCGTGCCCAGCCC<br>GATGCCGGTGGCGATCCGGCGCTTCTATTCGAGCGACCTCGATTAC<br>GTCGGCACGCTTGGGCGCGGCTGGGTGCTGCCGTGGGAGCTGCGC<br>CTGCACGCGCGTGACGGTCGGCTCTGGTACACCGACGCGCAGGGG<br>CGCGAGAGCGGCTTCCCGATCCTGAAACCGGGCCAGGCCGCGTTC<br>AGCGAGGCCGATCAGCGCTATCTGACCTGCACGCCGGATGGCCGC<br>TACATCCTCCACGACGTCGGCGAAACCTATTACGACTTCGGCCGCT<br>ACGAGCCGGGCTCGGGCCGCATCGGCTGGGTGCGCCGGATCGAGG<br>ATCAGGCCGGCCAGTGGTGCCAGTTCGAGCGCGACAGCCGTGGCC<br>GCGTGCGTGAAATCCAGACCTGCGGCGGCTTGCTGGCCGTGCTCG<br>ATTACGAGCCGGAGCACGAGCGGCTCGCCGAGGTGTCGCTCGTCA<br>GCGGCGATCAGCGCCGCCTCGTCGTGGCCTACGGCTACGACGAAA<br>ACGGCCAGATGGCCTCCGTGACCGACGCGAACGGCGCGGTGGTGC<br>GCCGCTTCACCTATGCCGACGGGCGCATGACGAGCCATTCGAACG<br>CGCTCGGTTTCACGTCGGGCTATACGTGGAAGGTCATCGACGGCA<br>CGCCGCGAGTGGTCGCCACCCACACCAGCGAGGGCGAGGCCTGGG<br>CGTTCGAGTACGACATCGAAGGCCGCCGCACCCATGTGCGGCATG<br>CCGACGGCCGCCACGCGCAATGGCGCTACGACGCGCAATTCCAGA<br>TCGTCGAGTACCTCGATTTCGACGGCCGTCGCTACGGGCTCAAGTA<br>CAACGCTGCCGGCATGCCCGTGATGCTGACGCTGCCCGGCGAACG<br>AACCGTGATGTTCGAGTACGACGACGCCGGCCGCATCGTCGCCGA<br>AACCGATCCCCTCGGCCGCACCACGAAAACGCGCTACGACGGCAA<br>CAGCATGCGGCCCGTCGAGATCATCTTGCCCGACGGCAGCGCCTG<br>GCACGCCGAATACGACCGGCAGGGCCGGCTGCTCGTCACCCGTGA<br>TCCGCTCGACCGGGAGAATCGCTACGAATATCCGGAGGCACTGAG<br>CGCGCTCCCGGTGGCGCATGTCGATGCGCTGGGCGGGCGCAAGAC<br>GTTCGAGTGGAACCGGCTCGGCGAGCTGGTGGCCTACACCGATTG<br>CTCGGGCAAGACCACGCGCAATTTTTTCGATGCATTCGGCCTGCCG<br>CTCGCGCGCGAGAACGCGCTCGGGCACCGCGTGTCGTTCGATCTG<br>CGCCCGACCGGCGAGACGCGCCGCGTCACCTATCCCGACGGCAGT<br>TCCGAAAGCTACGAATACGACGCCGCCGGGCTGATGATCCGGCAC<br>ATCGGGCTGGGCGGCCGGATGCAGACGTTGCAGCGCAATGCGCGC<br>GGGCAACTCGTCGAGGCGGTCGATCCGGCCGGGCGGCGAACCCGC<br>TACCACTACGACGCCGAAGGGCGGCTGCGCGAGCTGCAACAGGCC |

-continued

| DddA Description | DddA amino acid and/or nucleotid sequence |
|---|---|
| | CACGCGCGCTACGCATTCGCGTACAGCGCAGGCGGGCGGCTTGTC AGCGAAACGCGGCCCGACGGCGTGCTGCGCCGCTTCGAATACGGC GAGGCCGGCGATCTGGCGGCGCTCGAGATCGTCGGAACGGCCGAT GATTGCGCTCCAAACGATCGCCCGGTTCGCGCGATCCGCTTCGAGC GCGACCGGATGGGTAACCTGTGCGTGCAGCACACGCCTACCGAGG TGACGCGCTACGAGCGCGACGCCGGCGGCCGCCTGCTCGAAGTCG CGAGCGTGCCGACCGCGGCCGGACTGGCGCTCGGCATCGCGCCCG ACACGCTGACCTTCGAATACGACAAGGCCGGGCGGCTGAGCGCCG AACACGGCGCGAACGGCAGCGTCCAGTACACGCTCGACGCGCTCG ACAACGTGTTGAAGCTCGCCTTGCCGCACGAACAGACGCTGCAGA TGCTGCGCTACGGCTCGGGGCACGTGCACCAGATTCGCCACGGCG ACCAGGTCGTCAGCGATTTCGAGCGCGACGACCTGCATCGCGAGT TGACGCGCACGCAGGGCCCCCTGACCGAGCGGACCGCCTACGACC TGCTGGGCCGCAAGATCTGGCAATCAGCCGGCTTCCAGCCCGACG CGCTTGCGCGTGGGCAGGGCCAGCTGTGGCGCAACTACGGCTACG ACGCCGCCGGGGAACTGGTCGAGAGCCACGACAGCCTGCGCGGCA GCACGCAGTTCAGCTACGATCCGGCCGGCTATCTGACGCAGCGCG TGAACACCGCCGACCGGCAGCTCGAATCGTTCGCCTGGGACGCCG CCGGCAACCTGCTCGACGATGCGCAACGCAGCAGCCGCGGCTATG TCGAGGGCAACCGGCTGCGCATGTGGCAGAACCTGCGCTTCGACT ACGACGCGTTCGGCAATCTCGCGACCAAGCTGCGCGGCGCGAATC AGCGCCAGCAGTTCACGTACGATGGGCAGGATCGGCTCGTGGCCG TGCGCACGCAGGGCGCGCGCGGCGTGGTGGAGACGCGTTTCGCCT ACGATCCGCTCGGGCGGCGCATCGCCAAGACCGATAGGACACTCG ACGTGCGCGGCGTAACGCTGCGCGAGGAAACGAAGCGGTTCGTAT GGGAAGGGCTGCGGCTCGCGCAGGAGGTGCGCGACACCGGCGTG AGCAGCTACGTGTACAGCCCGGATGCGCCTTACATGCCCGCGGCG CGGGTCGATGCGGTGAAAGCCGAAGCGCTCGCAAACGCCGCGATC GACAAGGCCAGACAGGCGACGCGGATCTATCACTTTCATACCGAT GTGTCGGGCGCACCGCAAGAAGCGACGAACGAGGCCGGCGACAT TGTTTGGGCCGGCCAATACTCAGCCTGGGGCAAGGTGGCGCCGAA CCAGCATGCCCCAGCCCGGATCGATCAGCCGCTCCGCTACGCCGG ACAATATGCCGATGACAGTACCGAGCTGCACTACAACACGTTTCG TTTCTACGATCCGGATGTCGGCCGGTTTATCAATCAGGATCCAATC GGGTTGATGGGGGGGCTGAATCTTTACCAATATGCACCCAACTCA ATCGCGTGGACCGACTGGTGGGGGCTGGCCGGCAGCTATACGCTC GGTTCCTATCAAATTTCTGCTCCTCAACTTCCCGCCTACAATGGGC AGACTGTTGGGACCTTCTACTATGTAAACGACGCGGGCGGGCTCG AATCGAGGACATTCTCTTCTGGAGGGCCGACCCCTTATCCAAATTA TGCCAATGCCGGGCACGTGGAAGGCCAGTCCGCACTGTTCATGAG GGATAACGGAATTTCAGACGGACTGGTTTTCCACAACAACCCTGA GGGTACTTGCGGATTCTGCGTCAATATGACCGAAACGCTTTTGCCT GAAAATTCCAAACTTACCGTCGTTCCGCCCGAGGGCTCGATTCCGG TCAAGCGGGGCGCGACGGGCGAAACGAGAACATTTACAGGGAAC AGCAAGTCTCCGAAGTCCCCTGTCAAAGGAGGATGTTGA (SEQ ID NO: 131) |
| DddA homolog in *Burkholderia glumae* LMG 2196 PROTEIN | >AJY63123.1 RHS repeat-associated core domain protein [*Burkholderia glumae* LMG 2196 = ATCC 33617] MYEAARVTDPIEHTSALTGFLVGAVLGIALIAAVAFATFTCGFGVALL AGMAAGIGAQVLLSLGESIGKMFSSQSGAITLGSPNVYVNGKPTAYA MLSSVTCSKHNPTPLVAQGSTNIFINGKPAARKDDKITCGATISDGSH DTYFHGGTQTCLPIDDEVPPWLRTATDWAFALAGLVGGLGGLLKEA GGLSRAVMPCAAKFIGGYVLGEAASRYVVGPAINSAIGGMFGNPVDV TTGRKILLAESETDYVVPSPMPVAIRRFYSSDLDYVGTLGRGWVLPW ELRLHARDGRLWYTDAQGRESGFPMLQPGHAAFSEADQRYLTCTPD GRYILHDLGETYYDFGHYEPGSGRIGWVRRIEDQAGQWCQFERDSRG RVREIQTCGGLLAVLDYEPEHGRLAGVSLVSGDQRRLVVAYGYDEH GQMASVTDANGALVRRFTYADGRMTSHSNALGFTSGYTWQAVGGA PRVVATHTSEGEAWAFEYDIEGRRTHVRHADGRHAQWRYDAQFQIV EYLDFDGRRYGLKYNDAGMPVMLTLPGERTVTFEYDDAGRIVAETD PLGRTTKTRYDGNSRRPVEIIAPDGSAWHAEYDRQGRLLATRDPLDR ENRYEYPKALSALPIAHVDALGGRKTFEWNRLGELVAYTDCSGKTTR NFYDAFGLPLARENALGHRVTFDLRPTGEARRVTYPDGSTESYEYDA AGLMIRHVGLGGRTQIALRNARGQIVEAVDPAGRRTCYRYDAEGRL RELQQGHARYAFTYSAGGRLTSETRPDGVRRRFEYGEAGDLAALDIV GAADDATANDRPVRTIRFERDRMGNLCAQHTPTEVTRYTRDTGGRL LEVACVPTAAGLALGIAPDTLTFEYDKAGRLSAEHGANGSVRYTLDA LDNVMKLALPHEQTLQMLRYGSGHVHQIRCGDQVVSDFERDDLHRE LTRTQGRLTERTAYDLLGRKIWQSAGFQPDALARGQGQVWRNYGY DAAGELAESHDSLRGSTQFSYDPAGYLTQRVNTADRQLESFAWDAA GNLLDDAQRRSRGYVEGNRLRMWQNLRFEYDPFGNLATKLRGANQ RQQFTYDGQDRLVAVRTQDARGVVETRFAYDPLGRRIAKTDIVRDA RGVALREETKRFVWEGLRLAQEVRDTGVSSYVYSPDAPYTPAARVD AVLAEAMAAAIEQARQATRIYHFHTDVSGAPQEATNEAGDIVWAG QYSAWGKVAPNQHAPARIDQPLRYAGQYADDSTELHYNTFRFYDPD |

-continued

| DddA Description | DddA amino acid and/or nucleotid sequence |
|---|---|
| | VGRFINQDPIGLMGGLNLYQYAPNSIAWTDWWGLAGSYTLGSYQISA<br>PQLPAYNGQTVGTFYYVNGAGGLESRTFSSGGPTPYPNYANAGHVE<br>GQSALFMRDNGISDGLVFHNNPEGTCGFCVNMTETLLPENSKLTVVP<br>PEGAIPVKRGATGETRTFTGNSKSPKSPVKGEC [SEQ ID NO: 132] |
| DddA homolog in *Burkholderia glumae* LMG 2196 DNA | >KS03_3390 CP009434.1: 65330-69607 *Burkholderia glumae* LMG 2196 =<br>ATCC 33617 chromosome II, complete sequence<br>GTGTACGAAGCGGCCCGCGTCACCGACCCGATCGAACACACCAGC<br>GCGCTGACCGGCTTTCTGGTGGGCGCCGTGCTCGGCATTGCCCTGA<br>TCGCCGCGGTGGCGTTCGCCACCTTCACCTGCGGCTTCGGCGTGGC<br>GCTGCTGGCCGGCATGGCCGCCGGCATCGGCGCGCAGGTGCTGTT<br>GTCGTTAGGAGAATCGATCGGGAAGATGTTCAGTTCGCAATCCGG<br>CGCGATCACGCTCGGCTCGCCGAACGTCTATGTGAACGGCAAGCC<br>GACCGCCTACGCCATGCTCAGCAGCGTGACGTGCAGCAAGCACAA<br>CCCGACGCCGCTCGTCGCGCAGGGGTCCACCAACATCTTCATCAA<br>CGGCAAGCCGGCCGCCCGCAAGGACGACAAGATCACCTGCGGCGC<br>GACCATCTCCGACGGCTCGCACGACACCTATTTCCACGGCGGCAC<br>CCAGACCTGCCTGCCGATCGACGACGAAGTGCCGCCGTGGCTGCG<br>CACCGCCACCGACTGGGCGTTCGCGCTGGCCGGGCTGGTGGGCGG<br>GCTCGGCGGCCTGCTCAAGGAAGCGGGGGGCTGTCGCGCGCGGT<br>GATGCCGTGCGCGGCGAAGTTCATCGGCGGCTACGTGCTCGGCGA<br>GGCGGCGAGCCGCTACGTGGTCGGCCCGGCCATCAACAGCGCGAT<br>CGGCGGGATGTTCGGCAACCCGGTGGACGTCACCACCGGGCGCAA<br>GATCCTGCTGGCGGAATCGGAAACCGATTACGTGGTGCCCAGCCC<br>GATGCCGGTGGCGATCCGGCGCTTCTATTCGAGCGACCTCGACTAC<br>GTCGGCACGCTCGGGCGCGGCTGGGTGCTGCCGTGGGAACTGCGG<br>CTGCACGCGCGCGACGGGCGGCTCTGGTACACCGACGCGCAGGGG<br>CGCGAGAGCGGCTTCCCGATGCTCCAGCCGGGCCATGCCGCGTTC<br>AGCGAGGCCGACCAGCGCTATCTGACCTGCACCCCGGATGGCCGC<br>TACATCCTGCACGACCTCGGCGAAACCTATTACGACTTCGGCCACT<br>ACGAGCCGGGCTCGGGCCGCATCGGCTGGGTGCGCCGCATCGAGG<br>ATCAGGCCGGCCAGTGGTGCCAGTTCGAGCGCGACAGCCGCGGCC<br>GCGTGCGCGAAATCCAGACCTGCGGCGGCTTGCTGGCCGTGCTCG<br>ATTACGAGCCGGAACACGGGCGGCTCGCCGGGGTGTCGCTCGTCA<br>GCGGGGATCAGCGCCGCCTCGTGGTGGCTTACGGCTATGACGAGC<br>ACGGCCAGATGGCGTCCGTGACCGATGCGAACGGCGCGCTGGTGC<br>GCCGCTTCACCTATGCCGACGGGCGCATGACGAGCCATTCGAACG<br>CGCTCGGCTTCACGTCGGGCTATACGTGGCAAGCCGTCGGCGGCG<br>CGCCGCGGGTGGTTGCCACCCACACCAGCGAGGGCGAGGCCTGGG<br>CCTTCGAGTACGACATTGAAGGACGCCGCACCCACGTGCGTCACG<br>CCGACGGCCGCCACGCGCAATGGCGCTACGACGCGCAATTCCAGA<br>TCGTCGAGTACCTCGATTTCGACGGCCGGCGCTACGGGCTCAAGT<br>ACAACGACGCCGGCATGCCCGTGATGCTGACGCTGCCCGGCGAAC<br>GGACCGTGACGTTCGAGTACGACGATGCCGGCCGCATCGTCGCCG<br>AAACCGATCCACTCGGCCGCACCACGAAAACGCGCTACGACGGCA<br>ACAGCAGGCGGCCCGTCGAGATCATCGCGCCCGACGGCAGCGCCT<br>GGCACGCCGAATACGACCGGCAAGGCCGGCTGCTCGCCACCCGCG<br>ATCCGCTCGACCGGGAAAACCGCTACGAATACCCGAAGGCGCTCA<br>GCGCGCTGCCGATCGCGCACGTCGATGCGCTGGGCGGGCGCAAGA<br>CGTTCGAGTGGAACCGGCTCGGCGAGCTGGTGGCCTATACCGATT<br>GCTCGGGCAAGACCACACGCAATTTTTACGACGCATTCGGTCTGCC<br>GCTCGCGCGCGAGAACGCGCTCGGCCACCGCGTGACGTTCGACCT<br>GCGCCCGACCGGCGAGGCGCGGCGCGTCACCTATCCCGACGGCAG<br>TACAGAAAGCTACGAATACGACGCCGCCGGGCTGATGATCCGGCA<br>CGTCGGGCTGGGCGGCCGGACGCAGATTGCGCTGCGCAACGCGCG<br>TGGGCAGATCGTGGAGGCGGTCGATCCGGCCGGACGGCGCACCTG<br>CTACCGCTACGACGCCGAGGGGCGGCTGCGCGAGCTGCAACAGGG<br>GCACGCGCGTTACGCGTTCACCTACAGCGCGGGCGGGCGGCTCAC<br>CAGCGAAACCCGGCCCGACGGCGTGCGGCGCCGCTTCGAATACGG<br>CGAGGCCGGCGATCTGGCGGCGCTCGACATCGTCGGCGCGGCCGA<br>CGACGCCACGGCGAACGATCGTCCGGTTCGCACCATCCGCTTCGA<br>GCGCGACCGCATGGGCAATCTGTGCGCGCAGCACACGCCCACCGA<br>GGTGACGCGCTACACGCGCGACACCGGCGGCCGCCTGCTCGAAGT<br>CGCATGCGTGCCGACCGCGGCCGGGCTGGCGCTCGGCATCGCGCC<br>CGACACGCTGACCTTCGAATACGACAAGGCCGGGCGGCTGAGTGC<br>CGAACACGGCGCGAACGGCAGCGTCCGATACACGCTCGACGCGCT<br>CGACAACGTGATGAAGCTCGCCCTGCCGCACGAGCAGACGCTGCA<br>GATGCTGCGCTACGGCTCGGGGCACGTGCATCAGATCCGCTGCGG<br>CGACCAGGTGGTCAGCGATTTCGAGCGCGACGACCTGCATCGCGA<br>GCTGACGCGCACTCAGGGCCGCCTGACCGAGCGTACCGCCTACGA<br>CCTGCTGGGCCGCAAGATCTGGCAATCGGCCGGCTTCCAGCCCGA<br>CGCGCTTGCGCGCGGGCAGGGCCAGGTGTGGCGCAACTACGGCTA<br>CGACGCCGCCGGCGAACTGGCCGAGAGCCACGATAGCCTGCGCGG<br>CAGCACGCAGTTCAGCTACGATCCGGCCGGCTATCTGACGCAGCG<br>CGTCAATACCGCCGACCGGCAGCTCGAATCGTTCGCCTGGGATGC<br>CGCCGGCAACCTGCTCGACGATGCGCAGCGCCGCAGCCGCGGTTA |

-continued

| DddA Description | DddA amino acid and/or nucleotid sequence |
|---|---|
| | TGTCGAGGGCAACCGGCTGCGCATGTGGCAGAACCTGCGCTTCGA ATACGACCCGTTCGGCAATCTCGCGACCAAGCTGCGCGGCGCGAA CCAGCGCCAGCAGTTCACTTACGACGGGCAGGATCGGCTCGTGGC GGTGCGCACGCAGGACGCGCGCGGCGTGGTGGAGACGCGTTTCGC CTACGATCCGCTGGGGCGGCGCATCGCCAAGACGGATATTGTGCG CGACGCGCGCGGCGTAGCGCTGCGCGAGGAAACGAAGCGGTTCGT GTGGGAGGGGCTGCGGCTCGCGCAGGAGGTGCGCGACACGGGCG TGAGCAGCTACGTGTACAGCCCGGACGCGCCCTATACGCCCGCGG CGCGCGTGGATGCCGTGCTGGCCGAGGCCATGGCCGCCGCTGCCA TCGAGCAGGCCAGACAGGCGACGCGGATCTATCACTTTCATACCG ATGTGTCGGGCGCACCGCAAGAAGCGACGAACGAGGCTGGCGAC ATTGTTTGGGCCGGCCAATACTCAGCCTGGGGCAAGGTGGCGCCG AACCAGCATGCCCCCGCCCGGATCGATCAGCCGCTCCGCTACGCC GGACAATATGCCGACGACAGTACCGAGCTGCACTACAACACGTTT CGTTTCTACGATCCGGACGTCGGCCGGTTTATCAATCAGGATCCAA TCGGGTTGATGGGGGGGCTGAATCTTTACCAATATGCACCCAACTC GATCGCATGGACCGACTGGTGGGGGCTGGCCGGCAGCTATACGCT CGGTTCCTATCAAATTTCTGCGCCTCAACTTCCGGCCTACAATGGA CAGACTGTTGGGACCTTCTACTACGTGAACGGCGCGGGCGGGCTC GAATCGAGGACATTCTCTTCCGGAGGGCCGACCCCTTATCCAAATT ATGCCAATGCCGGGCACGTGGAGGGCCAGTCCGCGCTGTTCATGA GGGATAACGGAATTTCAGACGGACTGGTTTTCCACAACAACCCTG AGGGCACTTGCGGATTCTGCGTTAATATGACCGAAACGCTTTTGCC TGAAAATTCCAAACTTACCGTCGTTCCGCCCGAGGGCGCGATCCC GGTCAAGCGGGGCGCGACGGGCGAAACGAGAACATTTACGGGGA ACAGCAAGTCTCCGAAGTCCCCTGTCAAAGGAGAATGTTGA [SEQ ID NO: 133] |
| DddA homolog in *Burkholderia glumae* BGR1 PROTEIN | >ACR30728.1 Rhs family protein [*Burkholderia glumae* BGR1] MYEAARVTDPIEHTSALTGFLVGAVLGIALIAAVAFATFTCGFGVALL AGMAAGIGAQVLLSLGESIGKMFSSQSGAITLGSPNVYVNGKPTAYA MLSSVTCSKHNPTPLVAQGSTNIFINGKPAARKDDKITCGATISDGSH DTYFHGGTQTCLPIDDEVPPWLRTATDWAFALAGLVGGLGGLLKEA GGLSRAVMPCAAKFIGGYVLGEAASRYVVGPAINSAIGGMFGNPVDV TTGRKILLAESETDYVVPSPMPVAIRRFYSSDLDYVGTLGRGWVLPW ELRLHARDGRLWYTDAQGRESGFPMLQPGHAAFSEADQRYLTCTPD GRYILHDLGETYYDFGHYEPGSGRIGWVRRIEDQAGQWCQFERDSRG RVREIQTCGGLLAVLDYEPEHGRLAGVSLVSGDQRRLVVAYGYDEH GQMASVTDANGALVRRFTYADGRMTSHSNALGFTSGYTWQAVGGA PRVVATHTSEGEAWAFEYDIEGRRTHVRHADGRHAQWRYDAQFQIV EYLDFDGRRYGLKYNDAGMPVMLTLPGERTVTFEYDDAGRIVAETD PLGRTTKTRYDGNSRRPVEIIAPDGSAWHAEYDRQGRLLATRDPLDR ENRYEYPKALSALPIAHVDALGGRKTFEWNRLGELVAYTDCSGKTTR NFYDAFGLPLARENALGHRVTFDLRPTGEARRVTYPDGSTESYEYDA AGLMIRHVGLGGRTQIALRNARGQIVEAVDPAGRRTCYRYDAEGRL RELQQGHARYAFTYSAGGRLTSETRPDGVRRRFEYGEAGDLAALDIV GAADDATANDRPVRTIRFERDRMGNLCAQHTPTEVTRYTRDTGGRL LEVACVPTAAGLALGIAPDTLTFEYDKAGRLSAEHGANGSVRYTLDA LDNVMKLALPHEQTLQMLRYGSGHVHQIRCGDQVVSDFERDDLHRE LTRTQGRLTERTAYDLLGRKIWQSAGFQPDALARGQGQVWRNYGY DAAGELAESHDSLRGSTQFSYDPAGYLTQRVNTADRQLESFAWDAA GNLLDDAQRRSRGYVEGNRLRMWQNLRFEYDPFGNLATKLRGANQ RQQFTYDGQDRLVAVRTQDARGVVETRFAYDPLGRRIAKTDIVRDA RGVALREETKRFVWEGLRLAQEVRDTGVSSYVYSPDAPYTPAARVD AVLAEAMAAAIEQARQATRIYHFHTDVSGAPQEATNEAGDIVWAG QYSAWGKVAPNQHAPARIDQPLRYAGQYADDSTELHYNTFRFYDPD VGRFINQDPIGLMGGLNLYQYAPNSIAWTDWWGLAGSYTLGSYQISA PQLPAYNGQTVGTFYYVNGAGGLESRTFSSGGPTPYPNYANAGHVE GQSALFMRDNGISDGLVFHNNPEGTCGFCVNMTETLLPENSKLTVVP PEGAIPVKRGATGETRTFTGNSKSPKSPVKGEC [SEQ ID NO: 134] |
| DddA homolog in *Burkholderia glumae* BGR1 DNA | >bglu_2g02600 NC_012721.2: 303868-308145 *Burkholderia glumae* BGR1 chromosome 2, complete sequence GTGTACGAAGCGGCCCGCGTCACCGACCCGATCGAACACACCAGC GCGCTGACCGGCTTTCTGGTGGGCGCCGTGCTCGGCATTGCCCTGA TCGCCGCGGTGGCGTTCGCCACCTTCACCTGCGGCTTCGGCGTGGC GCTGCTGGCCGGCATGGCCGCCGGCATCGGCGCGCAGGTGCTGTT GTCGTTAGGAGAATCGATCGGGAAGATGTTCAGTTCGCAATCCGG CGCGATCACGCTCGGCTCGCCGAACGTCTATGTGAACGGCAAGCC GACCGCCTACGCCATGCTCAGCAGCGTGACGTGCAGCAAGCACAA CCCGACGCCGCTCGTCGCGCAGGGGTCCACCAACATCTTCATCAA CGGCAAGCCGGCCGCCCGCAAGGACGACAAGATCACCTGCGGCGC GACCATCTCCGACGGCTCGCACGACACCTATTTCCACGGCGGCAC CCAGACCTGCCTGCCGATCGACGACGAAGTGCCGCCGTGGCTGCG CACCGCCACCGACTGGGCGTTCGCGCTGGCCGGGCTGGTGGGCGG GCTCGGCGGCCTGCTCAAGGAAGCGGGCGGGCTGTCGCGCGCGGT |

-continued

| DddA Description | DddA amino acid and/or nucleotid sequence |
|---|---|
| | GATGCCGTGCGCGGCGAAGTTCATCGGCGGCTACGTGCTCGGCGA<br>GGCGGCGAGCCGCTACGTGGTCGGCCCGGCCATCAACAGCGCGAT<br>CGGCGGGATGTTCGGCAACCCGGTGGACGTCACCACCGGGCGCAA<br>GATCCTGCTGGCGGAATCGGAAACCGATTACGTGGTGCCCAGCCC<br>GATGCCGGTGGCGATCCGGCGCTTCTATTCGAGCGACCTCGACTAC<br>GTCGGCACGCTCGGGCGCGGCTGGGTGCTGCCGTGGGAACTGCGG<br>CTGCACGCGCGCGACGGGCGGCTCTGGTACACCGACGCGCAGGGG<br>CGCGAGAGCGGCTTCCCGATGCTCCAGCCGGGCCATGCCGCGTTC<br>AGCGAGGCCGACCAGCGCTATCTGACCTGCACCCCGGATGGCCGC<br>TACATCCTGCACGACCTCGGCGAAACCTATTACGACTTCGGCCACT<br>ACGAGCCGGGCTCGGGCCGCATCGGCTGGGTGCGCCGCATCGAGG<br>ATCAGGCCGGCCAGTGGTGCCAGTTCGAGCGCGACAGCCGCGGCC<br>GCGTGCGCGAAATCCAGACCTGCGGCGGCTTGCTGGCCGTGCTCG<br>ATTACGAGCCGGAACACGGGCGGCTCGCCGGGGTGTCGCTCGTCA<br>GCGGGGATCAGCGCCGCCTCGTGGTGGCTTACGGCTATGACGAGC<br>ACGGCCAGATGGCGTCCGTGACCGATGCGAACGGCGCGCTGGTGC<br>GCCGCTTCACCTATGCCGACGGGCGCATGACGAGCCATTCGAACG<br>CGCTCGGCTTCACGTCGGGCTATACGTGGCAAGCCGTCGGCGGCG<br>CGCCGCGGGTGGTTGCCACCCACACCAGCGAGGGCGAGGCCTGGG<br>CCTTCGAGTACGACATTGAAGGACGCCGCACCCACGTGCGTCACG<br>CCGACGGCCGCCACGCGCAATGGCGCTACGACGCGCAATTCCAGA<br>TCGTCGAGTACCTCGATTTCGACGGCCGGCGCTACGGGCTCAAGT<br>ACAACGACGCCGGCATGCCCGTGATGCTGACGCTGCCCGGCGAAC<br>GGACCGTGACGTTCGAGTACGACGATGCCGGCCGCATCGTCGCCG<br>AAACCGATCCACTCGGCCGCACCACGAAAACGCGCTACGACGGCA<br>ACAGCAGGCGGCCCGTCGAGATCATCGCGCCCGACGGCAGCGCCT<br>GGCACGCCGAATACGACCGGCAAGGCCGGCTGCTCGCCACCCGCG<br>ATCCGCTCGACCGGGAAAACCGCTACGAATACCCGAAGGCGCTCA<br>GCGCGCTGCCGATCGCGCACGTCGATGCGCTGGGCGGGCGCAAGA<br>CGTTCGAGTGGAACCGGCTCGGCGAGCTGGTGGCCTATACCGATT<br>GCTCGGGCAAGACCACACGCAATTTTTACGACGCATTCGGTCTGCC<br>GCTCGCGCGCGAGAACGCGCTCGGCCACCGCGTGACGTTCGACCT<br>GCGCCCGACCGGCGAGGCGCGGCGCGTCACCTATCCCGACGGCAG<br>TACAGAAAGCTACGAATACGACGCCGCCGGGCTGATGATCCGGCA<br>CGTCGGGCTGGGCGGCCGGACGCAGATTGCGCTGCGCAACGCGCG<br>TGGGCAGATCGTGGAGGCGGTCGATCCGGCCGGACGGCGCACCTG<br>CTACCGCTACGACGCCGAGGGGCGGCTGCGCGAGCTGCAACAGGG<br>GCACGCGCGTTACGCGTTCACCTACAGCGCGGGCGGGCGGCTCAC<br>CAGCGAAACCCGGCCCGACGGCGTGCGGCGCCGCTTCGAATACGG<br>CGAGGCCGGCGATCTGGCGGCGCTCGACATCGTCGGCGCGGCCGA<br>CGACGCCACGGCGAACGATCGTCCGGTTCGCACCATCCGCTTCGA<br>GCGCGACCGCATGGGCAATCTGTGCGCGCAGCACACGCCCACCGA<br>GGTGACGCGCTACACGCGCGACACCGGCGGCCGCCTGCTCGAAGT<br>CGCATGCGTGCCGACCGCGGCCGGGCTGGCGCTCGGCATCGCGCC<br>CGACACGCTGACCTTCGAATACGACAAGGCCGGGCGGCTGAGTGC<br>CGAACACGGCGCGAACGGCAGCGTCCGATACACGCTCGACGCGCT<br>CGACAACGTGATGAAGCTCGCCCTGCCGCACGAGCAGACGCTGCA<br>GATGCTGCGCTACGGCTCGGGGCACGTGCATCAGATCCGCTGCGG<br>CGACCAGGTGGTCAGCGATTTCGAGCGCGACGACCTGCATCGCGA<br>GCTGACGCGCACTCAGGGCCGCCTGACCGAGCGTACCGCCTACGA<br>CCTGCTGGGCCGCAAGATCTGGCAATCGGCCGGCTTCCAGCCCGA<br>CGCGCTTGCGCGCGGGCAGGGCCAGGTGTGGCGCAACTACGGCTA<br>CGACGCCGCCGGCGAACTGGCCGAGAGCCACGATAGCCTGCGCGG<br>CAGCACGCAGTTCAGCTACGATCCGGCCGGCTATCTGACGCAGCG<br>CGTCAATACCGCCGACCGGCAGCTCGAATCGTTCGCCTGGGATGC<br>CGCCGGCAACCTGCTCGACGATGCGCAGCGCCGCAGCCGCGGTTA<br>TGTCGAGGGCAACCGGCTGCGCATGTGGCAGAACCTGCGCTTCGA<br>ATACGACCCGTTCGGCAATCTCGCGACCAAGCTGCGCGGCGCGAA<br>CCAGCGCCAGCAGTTCACTTACGACGGGCAGGATCGGCTCGTGGC<br>GGTGCGCACGCAGGACGCGCGCGGCGTGGTGGAGACGCGTTTCGC<br>CTACGATCCGCTGGGGCGGCGCATCGCCAAGACGGATATTGTGCG<br>CGACGCGCGCGGCGTAGCGCTGCGCGAGGAAACGAAGCGGTTCGT<br>GTGGGAGGGGCTGCGGCTCGCGCAGGAGGTGCGCGACACGGGCG<br>TGAGCAGCTACGTGTACAGCCCGGACGCGCCCTATACGCCCGCGG<br>CGCGCGTGGATGCCGTGCTGGCCGAGGCCATGGCCGCCGCTGCCA<br>TCGAGCAGGCCAGACAGGCGACGCGGATCTATCACTTTCATACCG<br>ATGTGTCGGGCGCACCGCAAGAAGCGACGAACGAGGCTGGCGAC<br>ATTGTTTGGGCCGGCCAATACTCAGCCTGGGGCAAGGTGGCGCCG<br>AACCAGCATGCCCCCGCCCGGATCGATCAGCCGCTCCGCTACGCC<br>GGACAATATGCCGACGACAGTACCGAGCTGCACTACAACACGTTT<br>CGTTTCTACGATCCGGACGTCGGCCGGTTTATCAATCAGGATCCAA<br>TCGGGTTGATGGGGGGGCTGAATCTTTACCAATATGCACCCAACTC<br>GATCGCATGGACCGACTGGTGGGGGCTGGCCGGCAGCTATACGCT<br>CGGTTCCTATCAAATTTCTGCGCCTCAACTTCCGGCCTACAATGGA<br>CAGACTGTTGGGACCTTCTACTACGTGAACGGCGCGGGCGGGCTC<br>GAATCGAGGACATTCTCTTCCGGAGGGCCGACCCCTTATCCAAATT |

-continued

| DddA Description | DddA amino acid and/or nucleotid sequence |
| --- | --- |
| | ATGCCAATGCCGGGCACGTGGAGGGCCAGTCCGCGCTGTTCATGA<br>GGGATAACGGAATTTCAGACGGACTGGTTTTCCACAACAACCCTG<br>AGGGCACTTGCGGATTCTGCGTTAATATGACCGAAACGCTTTTGCC<br>TGAAAATTCCAAACTTACCGTCGTTCCGCCCGAGGGCGCGATCCC<br>GGTCAAGCGGGGCGCGACGGGCGAAACGAGAACATTTACGGGGA<br>ACAGCAAGTCTCCGAAGTCCCCTGTCAAAGGAGAATGTTGA [SEQ<br>ID NO: 135] |
| DddA<br>homolog in<br>*Streptomyces*<br>*rubrolavendulae*<br>PROTEIN | >AOT60363.1 tRNA nuclease WapA precursor [*Streptomyces*<br>*rubrolavendulae*]<br>MSSSDAGRAFGVPENVLARFTRYPGGARRRAGRTARARRLGIVLSAV<br>LSATLLPAEAWAIAPPAPRTGPTLDALQQEEEVDPDPAAMEELDDWD<br>GGPVEPPADYTPTEVTPPTGGTAPVPLDSAGEELVPAGTLPVRIGQAS<br>PTEEDPAPPAPSGTWDVTVEPRATTEAAAVDGAIIKLTPPASGSTPVD<br>VELDYGRFEDLFGTEWSSRLKLTQLPECFLTTPELEECGTPITIPTSNDP<br>ATGTVRATVDPADGQPQGLAAQSGGGPAVLAATDSASGAGGTYKAT<br>SLSATGSWTAGGSGGGFSWSYPLTIPDTPAGPAPKISLSYSSQSVDGRT<br>SVANGQASWIGDGWDYHPGFVERRYRSCNDDRSGTPNNDNSADKE<br>KSDLCWASDNVVMSLGGSTTELVRDDTTGTWVAQNDTGARIEYKD<br>KDGGALAAQTAGYDGEHWVVTTRDGTRYWFGRNTLPGRGAPTNSA<br>LTVPVFGNHTGEPCHAATYAASSCTQAWRWNLDYVEDVHGNAMVV<br>DWKKEQNRYAKNEKFKAAVSYDRDAYPTQILYGLRADDLAGPPAG<br>KVVFHAAPRCLESAATCSEAKFESKNYADKQPWWDTPATLHCKAGD<br>ENCYVTSPTFWSRVRLSAIETQGQRTPGSTALSTVDRWTLHQSFPKQR<br>TDTHPPLWLESITRVGFGRPDASGNQSSKALPAVTFLPNKVDMPNRV<br>LKSTTDQTPDFDRLRVEVIRTETGGETHVTYSAPCPVGGTRPTPASNG<br>TRCFPVHWSPDPAAFSDENLDKSGYEPPLEWFNKYVVTKVTEMDLV<br>AEQPSVETVYTYEGDAAWAKNTDEYGKPALRTYDQWRGYASVVTR<br>TGTTANTGAADATEQSQTRTRYFRGMSGDAGRAKVHVTLTDVTGTA<br>TTVEDLLPYQGMAAETLTYTKAGGDVAARELAFPYSRKTASRARPG<br>LPALEAYRTGTTRTDSIQHISGDRTRAAQNHTTYDDAYGLPTQTYSLT<br>LSPNDSGTLVAGDERCTVTTYVHNTAAHIIGLPDRVRATTGDCAAAP<br>NATTGQIVSDSRTAYDALGAFGTAPVKGLPVQVDTISGGGTSWITSAR<br>TEYDALGRATKVTDAAGNSTTTTYSPATGPAFEVTVTNAAGHATTTT<br>LDPGRGSALTVTDQNGRKTTSTYDELGRATGVWTPSRPVNQDASVR<br>FVYQIEDSKVPAVHTRVLRDAGTYEESIELYDGFLRPRQTQREALGGG<br>RIVTETLYNANGSAKEVRDGYLAEGEPARELFVPLSLDQVPSATRTA<br>YDGLGRPVRTTTLHRGVPRHSATTAYGGDWELSRTGMSPDGTTPLSG<br>SRAVKATTDALGRPARIQHFTTQNVSAESVDTTYTYDPRGPLAQVTD<br>AQQNTWTYTYDARGRKTSSTDPDAGAAYFGYNALDQQVWSKDNQ<br>GRLQYTTYDVLGRQTELRDDSASGPLVAKWTFDTLPGAKGHPVAST<br>RYNDGAAFTSEVTGYDTEYRPTGNKVTIPSTPMTTGLAGTYTYASTY<br>TPTGKVQSVDLPATPGGLAAEKVITRYDGEDSPTTMSGLAWYTADTF<br>LGPYGEVLRTASGEAPRRVWTTNVYDEDTRRLTRTTAHRETAPHPVS<br>TTTYGYDTVGNITSIADQQPAGTEEQCFSYDPMGRLVHAWTDGNSA<br>VCPRTSTAPGAGPARADVSAGVDGGGYWHSYAFDAIGNRTKLTVHD<br>RTDAALDDTYTYTYGKTLPGNPQPVQPHTLTQVDAVLNEPGSRVEPR<br>STYAYDTSGNTTQRVIGGDTQTLAWDRRNKLTSVDTNNDGTPDVKY<br>LYDASGNRLVEDDGTTRTLFLGEAEIVVNTAGQAVDARRYYSSPGAP<br>TTIRTTGGKTTGHKLTVMLSDHHSTATTAVELTDTQPVTRRRFDPYG<br>NPRGTEPTTWPDRRTYLGVGIDDPATGLTHIGAREYDASTGRFISVDP<br>VMDLTDPLQMNGYTYANADPINNSDPTGLLLDARGGGTQKCVGTCV<br>KDVTNRKGIPLPPGEEWKHEGEAQTDFNGDGFITVFPTVNVPAKWKK<br>AKKYTEAFYKAVDTACFYGRESCADPEYPSRAHSINNWKGKACKAV<br>GGKCPERLSWGEGPAFAGGFAIAAEEYAGRGGYRGGGARRGSPCKC<br>FLAGTEVLMADGSTKSIEDIKLGDEVVATDPVTGEAGAHPVSALIATE<br>NDKRFNELVIITSEGVERLTATHEHPFWSPSEGEWLEAGELRTGMTLR<br>SDSGETLVVAGNRAFTQRARTYNLTVADLHTYYVLAGQTPVLVHNA<br>NCGPHLKDLQKDYPRRTVGILDVGTDQLPMISGPGGQSGLLKNLPGR<br>TKANGEHVETHAAAFLRMNPGVRKAVLYIDYPTGTCGTCRSTLPDM<br>LPEGVQLWVISPRRTEKFTGLPD [SEQ ID NO: 136] |
| DddA<br>homolog in<br>*Streptomyces*<br>*rubrolavendulae*<br>DNA | >A4G23_03234 CP017316.1: 3756245-3763321 *Streptomyces*<br>*rubrolavendulae* strain MJM4426, complete genome<br>ATGTCCTCGTCCGATGCGGGACGCGCCTTCGGCGTGCCCGAAAAC<br>GTCCTGGCGCGTTTCACGCGGTATCCCGGCGGGGCGCGACGCCGT<br>GCCGGGCGCACGGCGCGCGCCCGGCGCCTGGGCATCGTGCTGTCC<br>GCCGTCCTCTCGGCGACCCTGCTGCCCGCCGAGGCATGGGCCATC<br>GCGCCCCCGGCGCCGCGCACCGGTCCGACCCTGGACGCCCTCCAG<br>CAGGAGGAGGAGGTCGATCCGGACCCGGCCGCCATGGAAGAGCT<br>GGACGACTGGGACGGTGGGCCGGTCGAGCCCCCGGCCGACTACAC<br>CCCCACCGAGGTCACGCCTCCCACCGGCGGCACCGCCCCGGTGCC<br>GCTGGACAGCGCGGGCGAGGAACTGGTCCCGGCCGGGACCCTGCC<br>CGTGCGCATCGGCCAGGCGTCCCCCACCGAGGAGGACCCGGCACC<br>CCCGGCACCCAGCGGCACGTGGGACGTCACCGTGGAGCCCCGCGC<br>CACCACCGAGGCGGCCGCCGTGGACGGCGCCATCATCAAGCTCAC |

-continued

| DddA Description | DddA amino acid and/or nucleotid sequence |
|---|---|
| | CCCGCCCGCCAGCGGCTCCACACCGGTCGACGTGGAACTCGACTA<br>CGGCCGGTTCGAGGACCTGTTCGGCACCGAGTGGTCCTCCCGGCTC<br>AAGCTGACGCAGCTCCCGGAGTGCTTCCTCACGACGCCCGAGCTG<br>GAGGAGTGCGGCACCCCCATCACCATCCCGACGAGCAACGACCCG<br>GCCACCGGGACGGTCCGGGCCACCGTCGACCCGGCCGACGGGCAG<br>CCGCAGGGCCTGGCCGCGCAGTCGGGCGGCGGTCCCGCCGTCCTC<br>GCCGCGACCGACTCGGCGTCCGGCGCCGGCGGCACGTACAAGGCG<br>ACCTCCCTCTCGGCCACCGGCTCCTGGACGGCCGGCGGCAGCGGC<br>GGCGGCTTCTCCTGGTCGTATCCGCTCACCATCCCGGACACCCCGG<br>CCGGCCCCGCGCCGAAGATCTCCCTGTCGTACTCCTCCCAGTCCGT<br>CGACGGCCGCACCTCCGTCGCCAACGGCCAGGCGTCGTGGATAGG<br>CGACGGCTGGGACTACCACCCCGGCTTCGTCGAGCGCCGCTACCG<br>CTCCTGCAACGACGACCGCTCCGGCACCCCGAACAACGACAACAG<br>TGCGGACAAGGAGAAGTCCGACCTGTGCTGGGCGAGCGACAACGT<br>CGTGATGTCGCTCGGCGGCTCCACCACCGAACTCGTCCGCGACGA<br>CACGACCGGCACGTGGGTCGCGCAGAACGACACCGGTGCCCGGAT<br>CGAGTACAAGGACAAGGACGGCGGAGCCCTGGCCGCCCAGACCG<br>CCGGCTACGACGGCGAGCACTGGGTCGTCACCACCCGCGACGGAA<br>CCCGCTACTGGTTCGGCCGCAACACCCTCCCCGGCCGCGGCGCCCC<br>CACGAACTCCGCCCTCACCGTCCCCGTCTTCGGCAACCACACCGGC<br>GAGCCCTGCCACGCCGCCACCTACGCCGCCTCCTCCTGCACCCAGG<br>CGTGGCGCTGGAACCTCGACTACGTCGAGGACGTCCACGGCAACG<br>CGATGGTCGTCGACTGGAAGAAGGAGCAGAACCGGTACGCGAAG<br>AACGAGAAGTTCAAGGCGGCTGTCTCCTACGACCGCGACGCGTAT<br>CCGACGCAGATCCTCTACGGCCTGCGCGCCGACGACCTGGCGGGC<br>CCGCCCGCCGGCAAGGTCGTCTTCCACGCCGCCCCGCGCTGCCTCG<br>AAAGCGCGGCCACCTGCTCCGAAGCCAAGTTCGAGTCCAAGAACT<br>ACGCGGACAAGCAGCCCTGGTGGGACACACCGGCCACCCTGCACT<br>GCAAGGCCGGTGACGAGAACTGCTACGTCACCTCGCCGACGTTCT<br>GGAGCCGCGTCCGCCTGTCGGCGATCGAGACGCAGGGTCAGCGCA<br>CGCCCGGCTCGACGGCGCTGTCCACGGTCGACCGCTGGACCCTGC<br>ACCAGTCGTTCCCGAAGCAGCGCACCGACACCCACCCGCCGCTCT<br>GGCTGGAGTCGATCACCCGCGTGGGCTTCGGCCGGCCGGACGCCT<br>CCGGCAACCAGTCGAGCAAGGCCCTCCCGGCGGTGACCTTCCTGC<br>CCAACAAGGTCGACATGCCGAACCGCGTGCTGAAGAGCACGACGG<br>ACCAGACGCCCGATTTCGACCGCCTGCGCGTCGAGGTCATCCGCA<br>CGGAGACCGGCGGCGAGACCCATGTGACGTACTCCGCCCCCTGCC<br>CCGTCGGCGGCACCCGCCCCACCCCGGCCTCCAACGGCACCCGCT<br>GCTTCCCGGTCCACTGGTCCCCCGACCCGGCGGCCTTCTCCGACGA<br>GAACCTGGACAAGAGCGGCTACGAGCCGCCCCTCGAGTGGTTCAA<br>CAAGTACGTCGTCACCAAGGTCACCGAGATGGACCTCGTGGCGGA<br>GCAGCCCAGCGTCGAGACCGTCTACACCTACGAGGGCGACGCCGC<br>CTGGGCGAAGAACACCGACGAGTACGGCAAGCCCGCCCTGCGCAC<br>CTACGACCAGTGGCGCGGCTACGCGAGCGTCGTCACCCGCACGGG<br>CACCACGGCCAACACCGGCGCCGCCGACGCCACCGAGCAGTCCCA<br>GACCCGCACCCGGTACTTCCGCGGCATGTCCGGCGACGCGGGCCG<br>CGCCAAGGTGCACGTCACGCTCACGGACGTGACCGGCACCGCGAC<br>CACCGTCGAGGACCTGCTCCCGTACCAGGGCATGGCCGCCGAGAC<br>CCTTACCTACACCAAGGCGGGCGGCGACGTCGCCGCCCGCGAGCT<br>GGCCTTCCCCTACAGCAGGAAGACCGCCTCCCGCGCCCGCCCCGG<br>CCTCCCCGCCCTGGAGGCGTACCGCACGGGCACGACGCGCACGGA<br>CTCCATCCAGCACATCAGCGGCGACCGGACGCGCGCCGCTCAGAA<br>CCACACCACATACGACGACGCGTACGGCCTGCCCACCCAGACCTA<br>CTCGCTGACACTCTCGCCGAACGACTCCGGCACCCTTGTCGCCGGT<br>GACGAGCGGTGCACCGTCACGACGTACGTCCACAACACCGCCGCG<br>CACATCATCGGCCTCCCCGACCGCGTCCGCGCCACGACGGGCGAC<br>TGCGCCGCCGCGCCGAACGCCACCACCGGCCAGATCGTCTCCGAC<br>AGCCGCACCGCGTACGACGCGCTCGGCGCCTTCGGCACGGCCCCG<br>GTCAAGGGCCTGCCGGTCCAGGTGGACACGATCTCCGGAGGCGGC<br>ACGAGCTGGATCACCTCGGCGCGCACGGAGTACGACGCGCTGGGC<br>CGTGCGACCAAGGTCACCGACGCGGCGGGCAACTCCACCACGACC<br>ACGTACAGCCCGGCGACCGGCCCCGCGTTCGAGGTCACCGTGACC<br>AACGCGGCTGGTCATGCCACGACCACCACCCTCGACCCCGGTCGC<br>GGCTCGGCGCTGACCGTCACCGACCAGAACGGCCGCAAGACCACC<br>AGCACGTACGACGAACTCGGCCGGGCCACCGGCGTGTGGACGCCC<br>TCCCGCCCGGTGAACCAGGACGCGTCCGTGCGCTTCGTCTACCAG<br>ATCGAGGACAGCAAGGTCCCGGCGGTGCACACTCGGGTCCTGCGC<br>GACGCCGGTACGTACGAGGAGTCGATCGAGCTCTACGACGGCTTC<br>CTCCGCCCCCGTCAGACCCAGCGCGAGGCGCTGGGCGGCGGCCGA<br>ATCGTCACCGAGACCCTCTACAACGCCAACGGCTCTGCGAAGGAA<br>GTGCGCGACGGCTACCTGGCGGAGGGCGAGCCCGCGCGGGAACTG<br>TTCGTCCCGCTCTCCCTCGACCAGGTGCCGAGCGCGACGAGGACG<br>GCCTATGACGGCCTGGGCCGGCCCGTCCGGACGACGACCCTCCAC<br>AGGGGAGTCCCCCGGCACTCCGCCACCACGGCGTACGGCGGCGAC<br>TGGGAACTGAGCCGCACCGGCATGTCGCCCGACGGAACGACGCCG<br>CTCTCTGGCAGCCGCGCCGTGAAGGCGACGACGGACGCGCTCGGC |

-continued

| DddA Description | DddA amino acid and/or nucleotid sequence |
|---|---|
| | CGCCCGGCCCGCATCCAGCACTTCACCACCCAGAACGTGTCGGCC<br>GAGAGCGTCGACACCACGTACACCTACGACCCCCGCGGCCCCCTT<br>GCCCAGGTCACCGACGCCCAGCAGAACACCTGGACGTACACGTAC<br>GACGCCCGTGGGCGCAAGACGTCCTCCACCGACCCGGACGCGGGC<br>GCCGCCTACTTCGGCTACAACGCGCTGGACCAGCAGGTCTGGTCG<br>AAGGACAACCAGGGCCGCCTGCAGTACACGACGTACGACGTCCTG<br>GGCCGCCAGACCGAGCTGCGCGACGACTCCGCGTCCGGCCCGCTG<br>GTGGCGAAGTGGACCTTCGACACCCTGCCGGGCGCCAAGGGCCAC<br>CCGGTCGCGTCGACCCGCTACAACGACGGCGCCGCGTTCACCAGC<br>GAGGTGACCGGTTACGACACCGAGTACCGTCCGACCGGCAACAAG<br>GTCACCATCCCCAGCACCCCGATGACCACGGGCCTCGCCGGCACG<br>TACACGTACGCCAGCACGTACACCCCGACCGGCAAGGTCCAGTCC<br>GTCGACCTGCCCGCGACGCCCGGCGGGCTCGCCGCGGAGAAGGTG<br>ATCACCCGCTACGACGGCGAGGACTCGCCCACCACGATGTCGGGC<br>CTGGCCTGGTACACGGCCGACACCTTCCTCGGCCCGTACGGGGAA<br>GTGCTGCGCACGGCGTCGGGCGAGGCCCCGCGCCGCGTGTGGACG<br>ACCAACGTCTACGACGAGGACACCCGCCGCCTCACCAGGACCACC<br>GCGCACCGGGAGACGGCTCCCCACCCGGTCAGCACGACCACCTAC<br>GGCTACGACACGGTCGGCAACATCACGTCCATCGCCGACCAGCAG<br>CCGGCGGGTACCGAGGAGCAGTGCTTCTCGTACGACCCGATGGGG<br>CGCCTCGTCCACGCCTGGACGGACGGCAACAGCGCCGTCTGCCCC<br>AGGACGTCCACGGCACCGGGCGCCGGCCCGGCCCGCGCCGACGTC<br>TCGGCCGGTGTCGACGGCGGCGGATACTGGCACTCGTACGCGTTC<br>GACGCGATCGGCAACCGGACGAAGCTGACCGTCCACGACCGCACC<br>GACGCGGCCCTGGACGACACGTACACCTACACCTACGGCAAGACC<br>CTGCCGGGTAACCCGCAGCCGGTCCAGCCGCACACCCTCACCCAG<br>GTCGACGCGGTGCTCAACGAGCCCGGATCGAGAGTCGAACCGCGC<br>TCCACATACGCCTACGACACCTCCGGCAACACCACCCAGCGCGTC<br>ATCGGCGGCGACACCCAGACCCTGGCCTGGGACCGCCGCAACAAG<br>CTGACGTCCGTCGACACGAACAACGACGGCACACCGGACGTGAAG<br>TACCTGTACGACGCGTCGGGCAACCGCCTGGTCGAGGACGACGGC<br>ACCACGCGCACCCTCTTCCTCGGCGAGGCCGAGATCGTCGTCAAC<br>ACGGCCGGCCAGGCCGTGGACGCGCGCCGCTACTACAGCAGCCCC<br>GGCGCCCCGACGACGATCCGCACGACCGGCGGCAAGACCACGGG<br>CCACAAGCTGACCGTCATGCTGTCGGACCACCACAGCACGGCGAC<br>GACCGCGGTCGAGCTGACCGACACCCAGCCGGTCACCCGCCGCCG<br>CTTCGACCCGTACGGCAACCCCCGCGGCACCGAGCCGACCACCTG<br>GCCCGACCGCCGCACCTACCTGGGCGTCGGCATCGACGACCCCGC<br>CACGGGCCTGACCCACATCGGCGCCCGCGAATACGACGCATCGAC<br>GGGCCGCTTCATCTCCGTCGATCCGGTCATGGACCTCACGGACCCG<br>CTCCAGATGAACGGGTACACCTACGCCAACGCGGACCCGATCAAC<br>AACAGCGACCCCACCGGACTGTTGCTCGACGCCCGAGGCGGCGGC<br>ACTCAGAAGTGCGTGGGAACCTGCGTCAAGGACGTCACGAACCGA<br>AAGGGAATTCCGCTCCCGCCTGGCGAGGAGTGGAAGCATGAAGGG<br>GAGGCGCAAACCGATTTCAACGGTGACGGCTTCATCACCGTCTTCC<br>CGACCGTGAATGTTCCGGCGAAGTGGAAGAAGGCGAAGAAGTAC<br>ACGGAGGCTTTCTACAAGGCGGTTGATACTGCTTGCTTCTATGGAC<br>GCGAAAGCTGTGCGGATCCGGAGTACCCTTCGCGGGCGCATAGCA<br>TCAACAACTGGAAGGGAAAGGCATGCAAAGCCGTAGGGGGAAAA<br>TGCCCTGAGAGGTTGTCGTGGGGGGAGGGTCCGGCGTTCGCTGGT<br>GGCTTCGCGATAGCAGCGGAAGAGTATGCGGGGAGAGGGGGCTA<br>CCGGGGCGGTGGGGCGAGGAGGGGGTCGCCCTGTAAGTGCTTCCT<br>TGCCGGCACCGAGGTGCTCATGGCGGATGGCAGCACTAAAAGTAT<br>CGAGGACATCAAGCTCGGTGACGAAGTGGTTGCGACTGATCCGGT<br>AACCGGTGAGGCCGGTGCGCACCCTGTCTCGGCGCTGATCGCCAC<br>CGAGAACGACAAGCGTTTCAACGAGCTGGTCATTATCACCAGCGA<br>GGGTGTAGAGCGTCTTACCGCAACGCATGAGCACCCCTTCTGGTC<br>GCCATCCGAAGGGGAGTGGTTGGAGGCGGGTGAGCTGCGCACTGG<br>CATGACGCTGCGCTCCGACTCTGGCGAAACTCTCGTAGTCGCAGG<br>AAACCGCGCCTTCACCCAGCGAGCCCGGACCTACAACCTCACGGT<br>TGCAGACCTCCACACGTACTATGTGCTGGCGGGCCAGACTCCGGT<br>ACTGGTTCACAATGCAAACTGTGGACCTCACCTGAAGGACCTGCA<br>AAAGGACTACCCCCGGCGCACTGTGGGCATCCTTGACGTCGGAAC<br>TGATCAGCTCCCGATGATTAGCGGCCCAGGTGGCCAGTCGGGACT<br>TCTCAAGAACCTCCCAGGTCGTACGAAGGCCAACGGGGAGCACGT<br>GGAGACTCACGCAGCAGCGTTCTTGCGTATGAACCCGGGTGTCAG<br>AAAGGCCGTGCTCTACATCGACTACCCGACGGGGACCTGCGGAAC<br>ATGTAGAAGTACATTGCCTGACATGCTGCCCGAGGGTGTTCAGTTG<br>TGGGTGATCTCGCCGCGTAGGACTGAAAAATTCACGGGACTTCCT<br>GACTGA [SEQ ID NO: 137] |
| DddA homolog in *Plantactinospora* sp. BC1 PROTEIN | >AVT32940.1 hypothetical protein C6361_29650 [*Plantactinospora* sp. BC1]<br>MGDRLPAFVDGGDTLGIFSRGGIERDLASGVAGPASSLPKGTPGFNGL<br>VKSHVEGHAAALMRQNGIPNAELYINRVPCGSGNGCAAMLPHMLPE<br>GATLRVYGPNGYDRTFTGLPD [SEQ ID NO: 138] |

-continued

| DddA Description | DddA amino acid and/or nucleotid sequence |
|---|---|
| DddA homolog in *Plantactinospora* sp. BC1 DNA | >C6361_29650 CP028158.1: 6764267-6764614 *Plantactinospora* sp. BC1 chromosome, complete genome<br>CTGGGTGACCGGCTCCCTGCCTTCGTGGACGGTGGAGACACGTTG<br>GGCATCTTTTCTCGCGGAGGTATTGAGCGGGACCTCGCCAGCGGA<br>GTTGCGGGTCCTGCAAGTAGCCTTCCTAAAGGCACGCCTGGCTTCA<br>ATGGTCTTGTAAAGAGTCATGTTGAAGGGCATGCGGCTGCGCTAA<br>TGAGACAAAATGGAATTCCGAACGCTGAGCTGTATATCAACAGAG<br>TGCCGTGCGGTTCAGGTAATGGCTGCGCAGCGATGTTGCCGCATAT<br>GCTTCCGGAAGGTGCCACCCTCCGCGTATATGGGCCGAACGGGTA<br>CGATAGAACCTTCACTGGACTTCCGGACTGA [SEQ ID NO: 139] |
| DddA homolog in *Kitasatospora setae* KM-6054 PROTEIN | >BAJ27137.1 hypothetical protein KSE_13070 [*Kitasatospora setae* KM-6054]<br>MAAVPSAEALAAKRARDTIWTPPNTPLGSQTKSVDGENLVPGRLPGP<br>LEPEPADWTPGGPASVPAPGSADVTLGFDSAEAAAARKATGGAAPAS<br>DGAALRAGSLPVVIGAAKDAKSGAHRIRVELVDQAKSRAAHLDSPLI<br>ALTDTEPDTPPSGRTTKVSLDLKGIGAQTWADRARLVALPACALETP<br>DRPECQQQTPVQSSVDLRSGLLTAEVILPAATEGTAPPTKSSLGSGTAS<br>GVVQAGLTTAAPAKAAPTVLAATAGASGSGGSFSATSLSPSAAWGA<br>GSNVGNFTYSYPIQTPPSLGGTAPSVGLGYDSSAVDGKTSAQNSQSS<br>WLGEGWGYEAGFIERGYKSCNTAGIANSSDMCWGGQNATLSLAGHS<br>GTLVRDDTTGVWHLQSDDGTKIEQLTGAPNGLQNGEHWRITTTDGT<br>QFYFGRNHLPGGDGTDPASNSAFKEPVYSPKSGDPCYNSSTATGSWC<br>TMGWRWNLDYAVDVHGNLITYTYAQETNYYSRGAGQNSGSGTLTD<br>YTRAGYLTQIAYGQRLSEQVTAKGAAKAAALITFTAAERCVPSGSITC<br>TEAQRTTANASYWPDTPLDQVCASTGTCTRAGPTFFTTKRLASLTTQ<br>VLVSGAYRTVDTWTLTHSFKDPGDGNAKSLWLDSIQRTGTNGQTAV<br>TMPPVTFTAVMKPNRVDGDLTLKDGTKVTVTPFNRPRLQQVTTETG<br>GQINVVYTTSSDAAHPACSRLAGTMPAAADGNTLACAPVKWYLPGS<br>SSPDPVDDWFNKYLISAVTEQDAISGTTLIKATNYTYNGDAAWHRND<br>AEFTDAKTRTWDGFRGYQSVTSTTGSAYPGEAPRTQQTATYLRGMD<br>GDVKADGSTRSVQVANPLGGPALTDSPWLAGSSFATQTYDQAGGTV<br>ISANGSVAGGQQVTATHAQSGGMPALVARYPASQVTTTSKSKLSDGT<br>WRTNTTVSTSDPAHANRPLSSDDKGDGTPGAELCSTNGYATGTNPM<br>MLNILAERTVTKGACGTPVTSANTVSSARTLYDGKPYGQAGDLAEST<br>SALTLDHYDTGGNPVYVHTAASTFDAYGRLTSVSEANGATYDAAGN<br>QLTAPNLTPATTRTAYTPATGAIATTVTQTTPTGWTTTLTQDPGRAEA<br>LVSTDANGRATTQQYDGLGRLTAAWSPERATNLTPSQKFSYAVNGT<br>TGPSVVTSQWLKEAGGYAYKNELYDGLGRLRQVQRTSDTYSGRLIT<br>DTVYDSHGWPVKTASPYYEKTTAPNSTVYLPQDSQVPAQTWVTFDG<br>IGRTTRSAFVSYGQQQWATTTAYPGADRTDVTPPNGKYPTSTFTDGR<br>NQVSALWQYRTATPTGNPADATVTTYTYDAANRPATRKDAAGNTW<br>SYGYDLRGRQTTVTDPDTGTTTTAYDVNSRAVSTTDGKGNTLVVSY<br>DLIGRKTGLYQGSIAPANQLAGWTYDTLPGGKGKPTSSTRYVGGAGG<br>SAYTQAVTGYDAGYRPTGTSVTIPASEGKLAGTYTTGLTYNPVLGTL<br>KQTDLPAIGAAPAESVMYTYNISGVLQKSYSDTYYVYDVQYDAFGRP<br>VRTTTGDAGTQVVSTQLDKTDYTYNQAGDVTSVTDVQNGTATDAQ<br>CFTYDHLGRLTQAWTDTAGSTSTTSGTWTDTSGTVHNSGSSQSVPAL<br>GACANANGPASTGSPAKLSVGGPSPYWQSYGYDSTGNRTTLVQHDT<br>TGNTTKDTTTTQTFGPAGSVNTATGAPNTGGGTGGPHALLTSSTTGP<br>TGTQVTSYQYDQLGNTTAVTETSGTTTLAWNGEDKLASVTKTGQAQ<br>ATSYLYDADGNQLIRRNPGKTTLNLGSDEVTLDTAANSLTDTRYYSA<br>PGGISIARTTGPTGASALAYQASDPHGTANVQINVDAAQTTTRRPTDP<br>FGNPRGTQPAPNTWAGDKGFVGGTKDDTTGLTNLGAREYQPTTGRF<br>LNPDPLLDAGNPQQWNGYAYSDNDPVNSSDPSGLITNALADGDTYV<br>ARPAAFCVTMSCVEQTSGPGFWEDKRVGDAVFAAVVQATTQSNGN<br>GSSQTKKEKGIWGQAWDWTKKNGGAILGALVEGAVESTCFIGAGFA<br>APATGGITVIAGAAACGAVAGEAGALTTNILTPDADHSVDGITNDMV<br>VGEITGAAVSAASEGASSLAKPAVRKLLGMEAEEGLEAAGRAATGPC<br>NSFPAGVTVLLADGTTKPIEQIAQGDQVTATDPQTGTTQAEPVTDTIIG<br>HDDTEFTDLTLTNDADPRAPPSEITSTTHHPYWNATTSRWTDAGDLK<br>PGDHVRTPDGTELTVNTVYSYTTQPRTARNLTVADLHTYYVLAGNTP<br>VLVHNTGPGCGEPGFVSDAANSLSGRRITTGQIFDASGNPIGPEITSGG<br>GSLADRAQSYLADSPNIRNLPAKARYASADHVEAQYAVWMRENGV<br>TDASVVINQNYVCGLPLGCQAAVPAILPRGSTMTVWYPGSGSPIVLR<br>GVG [SEQ ID NO: 140] |
| DddA homolog in *Kitasatospora setae* KM-6054 DNA | >KSE_13070 NC_016109.1: 1451556-1458878 *Kitasatospora setae* KM-6054 DNA, complete genome<br>GTGCTGGGGACAGCGGCCGCGCTCGCGGTCATGATGTCCATGGCG<br>GCGGTGCCGTCCGCCGAGGCACTGGCCGCGAAGCGGGCACGCGAC<br>ACCATCTGGACGCCGCCCAACACCCCGCTGGGCAGCCAGACCAAG<br>TCCGTCGACGGCGAGAACCTCGTCCCGGGCCGCCTGCCCGGCCCC<br>CTGGAGCCGGAACCGGCCGACTGGACACCCGGCGGACCGGCATCC<br>GTGCCCGCTCCGGGCAGCGCGGACGTCACCCTCGGCTTCGACTCC |

-continued

| DddA Description | DddA amino acid and/or nucleotid sequence |
| --- | --- |
| | GCGGAGGCCGCCGCCGCCCGCAAGGCCACCGGCGGCGCCGCCCCC |
| | GCCTCCGACGGCGCGGCCCTCCGCGCGGGCTCCCTCCCCGTCGTCA |
| | TCGGCGCGGCGAAGGACGCCAAGAGCGGCGCCCACCGGATCCGC |
| | GTCGAGCTCGTGGACCAGGCCAAGAGCCGTGCCGCACACCTCGAC |
| | AGCCCGCTGATCGCACTCACCGACACCGAGCCGGACACCCCGCCC |
| | TCCGGTCGGACCACGAAGGTGTCCCTCGACCTGAAGGGCATCGGC |
| | GCCCAGACCTGGGCGGACCGCGCGCGACTCGTCGCCCTGCCCGCC |
| | TGCGCCCTGGAGACGCCCGACAGGCCCGAGTGCCAGCAGCAGACC |
| | CCCGTGCAGAGCTCCGTCGACCTGCGCTCCGGACTGCTGACGGCC |
| | GAGGTCATTCTGCCCGCCGCCACCGAGGGCACCGCCCCGCCCACC |
| | AAGAGCTCCCTCGGCTCGGGCACCGCCTCCGGCGTCGTCCAGGCC |
| | GGCCTCACCACGGCGGCGCCCGCCAAGGCCGCGCCCACGGTGCTC |
| | GCCGCGACCGCCGGCGCGTCCGGCTCGGGCGGCAGCTTCTCGGCG |
| | ACCTCGCTGTCGCCCTCCGCGGCCTGGGGCGCCGGCTCCAACGTCG |
| | GCAACTTCACCTACTCGTACCCGATCCAGACGCCTCCCTCGCTCGG |
| | CGGGACCGCCCCCTCCGTGGGCCTCGGGTACGACTCGTCCGCCGTC |
| | GACGGGAAGACCTCCGCGCAGAACTCCCAGTCCTCCTGGCTCGGC |
| | GAGGGCTGGGGCTACGAGGCCGGGTTCATCGAGCGCGGCTACAAG |
| | TCCTGCAACACGGCCGGCATCGCGAACTCCTCGGACATGTGCTGG |
| | GGCGGGCAGAACGCCACCCTCTCGCTGGCCGGCCACTCCGGCACC |
| | CTGGTGCGCGACGACACCACCGGCGTCTGGCACCTGCAGAGCGAC |
| | GACGGCACGAAGATCGAACAGCTCACCGGCGCGCCCAACGGCCTG |
| | CAGAACGGCGAGCACTGGCGGATCACCACGACCGACGGCACGCA |
| | GTTCTACTTCGGCCGCAACCACCTGCCCGGCGGCGACGGCACCGA |
| | CCCGGCGAGCAACTCCGCCTTCAAGGAACCGGTGTACTCGCCCAA |
| | GAGCGGCGACCCCTGCTACAACTCCTCCACCGCCACCGGCTCCTG |
| | GTGCACGATGGGCTGGCGCTGGAACCTCGACTACGCCGTCGACGT |
| | CCACGGCAACCTGATCACCTACACCTACGCCCAGGAGACCAACTA |
| | CTACAGCCGAGGCGCCGGCCAGAACAGCGGCAGCGGCACCCTGAC |
| | CGACTACACCCGCGCCGGCTACCTCACCCAGATCGCCTACGGCCA |
| | GCGCCTGAGCGAGCAGGTCACCGCCAAGGGCGCGGCCAAGGCCG |
| | CTGCCCTCATCACCTTCACCGCCGCGGAACGCTGCGTCCCGTCCGG |
| | CTCGATCACCTGCACCGAGGCACAGCGCACGACCGCGAACGCCTC |
| | GTACTGGCCGGACACCCCGCTCGACCAGGTCTGCGCCTCCACCGG |
| | CACCTGCACCCGGGCCGGCCCGACGTTCTTCACCACCAAGCGCCTC |
| | GCCTCCCTCACCACCCAGGTCCTGGTCTCCGGCGCCTACCGCACCG |
| | TCGACACCTGGACGCTCACCCATTCCTTCAAGGACCCGGGCGACG |
| | GCAACGCCAAGTCGCTGTGGCTCGACTCGATCCAGCGCACCGGCA |
| | CCAACGGGCAGACCGCGGTCACCATGCCGCCCGTCACCTTCACGG |
| | CGGTGATGAAGCCGAACCGGGTGGACGGGGACCTCACCCTCAAGG |
| | ACGGCACCAAGGTCACCGTCACCCCGTTCAACCGGCCCCGCCTCC |
| | AGCAGGTCACCACGGAGACCGGCGGCCAGATCAACGTCGTCTACA |
| | CCACCTCCTCCGACGCCGCGCACCCCGCCTGCTCGCGCCTGGCCGG |
| | CACCATGCCCGCCGCGGCGGACGGCAACACCCTCGCCTGCGCCCC |
| | CGTCAAGTGGTACCTGCCCGGATCCAGCTCCCCGGACCCGGTCGA |
| | CGACTGGTTCAACAAGTACCTGATCAGCGCCGTCACCGAACAGGA |
| | CGCGATCAGCGGCACCACCCTGATCAAGGCCACCAACTACACCTA |
| | CAACGGCGACGCCGCCTGGCACCGCAACGACGCCGAGTTCACCGA |
| | CGCCAAGACCCGCACCTGGGACGGCTTCCGCGGCTACCAGTCCGT |
| | CACCAGCACCACCGGCAGCGCCTACCCGGGCGAGGCCCCCAGGAC |
| | CCAGCAGACCGCGACCTACCTGCGCGGCATGGACGGCGACGTCAA |
| | GGCCGACGGCTCCACCCGCAGCGTCCAGGTCGCCAACCCGCTCGG |
| | CGGCCCGGCCCTCACCGACAGCCCGTGGCTGGCCGGCTCCAGCTT |
| | CGCCACCCAGACCTACGACCAGGCCGGCGGCACCGTCATCTCCGC |
| | CAACGGCTCCGTCGCCGGCGGCCAGCAGGTCACCGCCACCCACGC |
| | CCAGAGCGGCGGCATGCCGGCCCTGGTCGCCCGCTACCCCGCCTC |
| | CCAGGTCACCACCACCTCCAAGTCCAAGCTCTCCGACGGGACCTG |
| | GCGCACCAACACCACCGTCAGCACCAGCGACCCCGCGCACGCCAA |
| | CCGCCCCCTCAGCAGCGACGACAAGGGCGACGGCACCCCCGGCGC |
| | CGAACTGTGCAGCACCAACGGCTACGCCACCGGCACCAACCCGAT |
| | GATGCTGAACATCCTCGCCGAGCGGACGGTCACCAAGGGCGCCTG |
| | CGGCACCCCCGTGACCTCGGCCAACACCGTCTCCTCCGCCCGCACC |
| | CTCTACGACGGCAAGCCCTACGGCCAGGCCGGCGACCTCGCCGAG |
| | TCCACCAGCGCCCTGACCCTGGACCACTACGACACCGGCGGCAAC |
| | CCCGTCTACGTCCACACCGCCGCCTCCACCTTCGACGCCTACGGCC |
| | GGCTTACCAGCGTCAGCGAGGCCAACGGCGCCACCTACGACGCCG |
| | CGGGCAACCAGCTCACCGCGCCCAACCTCACCCCCGCCACCACCC |
| | GCACCGCCTACACCCCGGCCACCGGCGCCATCGCCACCACCGTCA |
| | CCCAGACCACGCCCACCGGCTGGACCACCACCCTCACCCAGGACC |
| | CGGGCCGCGCCGAAGCTCTGGTCTCCACCGACGCCAACGGCCGCG |
| | CCACCACCCAGCAGTACGACGGCCTCGGCCGCCTGACCGCCGCCT |
| | GGTCACCGGAGCGCGCGACCAACCTCACCCCCAGCCAGAAGTTCT |
| | CCTACGCGGTCAACGGCACCACCGGCCCCTCCGTCGTCACCTCCCA |
| | GTGGCTCAAGGAAGCCGGCGGCTACGCGTACAAGAACGAGCTGTA |
| | CGACGGCCTCGGCCGCCTGCGCCAGGTCCAGCGCACCAGCGACAC |
| | CTACTCCGGGCGGCTGATCACCGACACCGTCTACGACTCGCACGG |

-continued

| DddA Description | DddA amino acid and/or nucleotid sequence |
|---|---|
| | CTGGCCCGTCAAGACCGCCAGCCCGTACTACGAGAAGACCACCGC |
| | GCCCAACAGCACCGTCTACCTGCCGCAGGACTCCCAGGTGCCCGC |
| | CCAGACCTGGGTCACCTTCGACGGCATCGGCCGGACCACCCGCTC |
| | CGCGTTCGTCTCCTACGGACAGCAGCAGTGGGCCACCACCACCGC |
| | CTACCCCGGCGCCGACCGCACCGACGTCACCCCGCCCAACGGCAA |
| | ATACCCGACCAGCACCTTCACCGACGGCCGCAACCAGGTCAGCGC |
| | CCTGTGGCAGTACCGCACCGCCACCCCCACCGGCAACCCGGCCGA |
| | CGCGACCGTCACCACCTACACCTACGACGCCGCCAACCGGCCCGC |
| | CACCCGCAAGGACGCCGCCGGGAACACCTGGAGCTACGGCTACGA |
| | CCTGCGCGGCCGCCAGACCACCGTCACCGACCCCGACACCGGCAC |
| | CACCACCACCGCCTACGACGTCAACTCGCGCGCCGTCTCCACCACC |
| | GACGGCAAGGGCAACACCCTCGTCGTCAGCTACGACCTGATCGGC |
| | CGCAAGACCGGCCTCTACCAGGGCAGCATCGCCCCGGCCAACCAG |
| | CTCGCCGGCTGGACGTACGACACCCTGCCGGGCGGAAAGGGCAAG |
| | CCCACCTCCTCCACCCGCTACGTCGGGGGCGCCGGCGGCTCGGCCT |
| | ACACCCAGGCCGTCACCGGCTACGACGCCGGCTACCGGCCCACCG |
| | GCACCTCGGTGACGATCCCCGCCAGCGAAGGCAAGCTCGCCGGTA |
| | CCTACACCACCGGCCTGACGTACAACCCGGTCCTCGGCACGCTCA |
| | AGCAGACCGACCTGCCGGCCATCGGCGCGGCGCCCGCCGAGAGCG |
| | TCATGTACACCTACAACATCTCCGGCGTCCTGCAGAAGTCCTACAG |
| | CGACACCTACTACGTCTACGACGTGCAGTACGACGCCTTCGGCCG |
| | CCCGGTCCGCACGACCACCGGCGACGCCGGAACCCAGGTCGTCTC |
| | CACCCAGCTCGACAAGACCGACTACACCTACAACCAGGCCGGCGA |
| | CGTCACCTCGGTCACCGACGTCCAGAACGGCACCGCCACCGACGC |
| | CCAGTGCTTCACCTACGACCACCTCGGGCGCCTCACCCAGGCCTGG |
| | ACCGACACCGCGGGCTCCACCAGCACCACCAGCGGCACCTGGACC |
| | GACACCTCCGGCACCGTCCACAACAGCGGCTCCTCCCAGTCCGTCC |
| | CCGCACTCGGCGCCTGCGCCAACGCCAACGGCCCCGCCAGCACCG |
| | GCAGCCCCGCCAAGCTCTCCGTCGGCGGCCCCTCCCCGTACTGGCA |
| | GAGCTACGGCTACGACAGCACCGGCAACCGCACCACCCTCGTCCA |
| | GCACGACACCACCGGCAACACCACCAAGGACACCACCACCACCCA |
| | GACCTTCGGCCCCGCCGGATCGGTCAACACCGCCACCGGCGCCCC |
| | CAACACCGGCGGCGGCACCGGCGGCCCGCACGCCCTGCTCACCAG |
| | CAGCACCACCGGACCCACCGGGACCCAGGTCACCAGCTACCAGTA |
| | CGACCAGCTCGGCAACACCACCGCGGTCACCGAGACGTCCGGAAC |
| | CACCACCCTCGCCTGGAACGGCGAGGACAAGCTCGCCTCCGTCAC |
| | CAAGACCGGCCAGGCCCAGGCCACCAGCTACCTCTACGACGCCGA |
| | CGGCAACCAGCTCATCCGCCGCAACCCCGGCAAGACCACCCTCAA |
| | CCTCGGCAGCGACGAGGTCACCCTCGACACCGCCGCCAACTCCCT |
| | CACCGACACCCGCTACTACAGCGCCCCCGGCGGCATCAGCATCGC |
| | CCGCACCACCGGACCCACCGGCGCAAGCGCCCTCGCCTACCAGGC |
| | CTCCGACCCCCACGGCACCGCCAACGTCCAGATCAACGTCGACGC |
| | CGCCCAGACCACCACCCGCCGCCCCACCGACCCCTTCGGCAACCC |
| | CCGCGGCACCCAGCCCGCCCCCAACACCTGGGCCGGCGACAAGGG |
| | CTTCGTCGGCGGCACCAAGGACGACACCACCGGACTCACCAACCT |
| | CGGCGCCCGCGAATACCAACCCACCACCGGCCGCTTCCTCAACCC |
| | CGACCCACTCCTCGACGCCGGCAACCCCCAGCAGTGGAACGGCTA |
| | CGCCTACAGCGACAACGACCCCGTCAACAGCTCCGACCCCAGCGG |
| | ACTCATCACCAACGCCCTGGCCGACGGCGACACCTACGTCGCCCG |
| | CCCCGCCGCCTTCTGCGTCACCATGTCGTGCGTCGAGCAGACCAGC |
| | GGCCCCGGTTTCTGGGAGGACAAGCGCGTCGGTGACGCCGTCTTC |
| | GCCGCCGTCGTCCAGGCCACCACGCAGAGCAACGGCAACGGGTCA |
| | TCCCAGACCAAGAAAGAGAAGGGCATCTGGGGCCAGGCCTGGGA |
| | CTGGACCAAGAAGAACGGCGGCGCCATCCTCGGAGCGCTGGTAGA |
| | GGGAGCGGTCTTCAGCACATGCTTCATCGGAGCTGGATTCGCCGC |
| | ACCTGCAACGGGAGGAATCACCGTCATCGCCGGTGCTGCGGCCTG |
| | CGGGGCTGTGGCCGGCGAGGCAGGGGCACTGACCACCAATATCCT |
| | CACCCCAGATGCCGACCACTCCGTCGACGGCATCACCAACGACAT |
| | GGTCGTTGGTGAAATCACCGGGGCGGCTGTCAGCGCAGCGAGCGA |
| | GGGCGCAAGCTCCCTCGCCAAGCCGGCGGTCCGCAAACTCCTGGG |
| | CATGGAAGCCGAGGAAGGACTCGAGGCAGCAGGCCGCGCCGCCA |
| | CCGGACCTTGCAACAGTTTCCCGGCCGGCGTCACCGTCCTCCTCGC |
| | CGACGGCACCACCAAGCCCATCGAACAGATCGCCCAGGGCGACCA |
| | GGTAACCGCCACCGACCCGCAGACAGGCACCACCCAGGCAGAACC |
| | CGTCACCGACACGATCATCGGCCACGACGACACGGAATTCACCGA |
| | CCTCACCCTCACCAACGACGCAGACCCCCGCGCCCCGCCCAGCGA |
| | GATCACCTCCACCACCCACCACCCCTACTGGAACGCCACCACCAG |
| | CCGCTGGACCGATGCCGGCGACCTCAAGCCCGGCGACCACGTCCG |
| | CACCCCCGACGGCACCGAACTGACCGTCAACACCGTCTACAGCTA |
| | CACCACACAACCCCGGACCGCGCGCAACCTCACCGTCGCAGACCT |
| | CCACACGTACTATGTGCTCGCTGGAAATACGCCGGTCCTAGTGCAT |
| | AACACCGGCCCGGGATGTGGTGAGCCGGGATTCGTTAGTGACGCT |
| | GCTAATTCTCTCTCGGGCAGGCGCATCACCACGGGACAAATATTTG |
| | ATGCGAGCGGGAATCCGATCGGGCCTGAGATCACGAGCGGCGGCG |
| | GCAGTCTGGCAGATAGGGCGCAGAGTTATCTTGCCGACTCCCCTA |
| | ATATTCGAAATCTGCCCGCTAAGGCGAGATATGCGTCGGCTGACC |

-continued

| DddA Description | DddA amino acid and/or nucleotid sequence |
|---|---|
| | ACGTTGAGGCGCAATATGCAGTGTGGATGCGAGAAAATGGAGTGA<br>CCGACGCCAGTGTGGTCATCAATCAAAACTATGTATGTGGGCTGC<br>CCCTAGGCTGCCAGGCGGCGGTGCCCGCTATCCTCCCTCGCGGCTC<br>GACCATGACGGTATGGTATCCAGGGTCAGGAAGTCCCATCGTATT<br>GCGGGGAGTGGGTTAA [SEQ ID NO: 141] |
| DddA homolog in *Thauera* sp. K11 PROTEIN | >ATE59819.1 type IV secretion protein Rhs [*Thauera* sp. K11]<br>MRAFRLIACLLAFSAAAAPAAADTSSMLGRLPEASARQLKERLAPRG<br>LASAAALRQYLDASQRELDTAPEADDVPARSQRFAARAGELTALREQ<br>ARRDLASLEDAAKASGSAEATQRIGRIRGQVDARFDRLEGLFTTWRN<br>APQGSERRQARRELRAALATLRHAGTPAPAAIPVPTLGPLQPAGEPAA<br>NPPAARLPAYAQADDATGDPFTPGGFRLMKVAALPPAVAAEAATDC<br>SATSADLADDGKDVRLTQPIRDLAASLDYSPARILRWTQQNVAFEPY<br>WGALKGAEGVLQTRAGNSTDQASLLIALLRASNIPARYVRGTVQLND<br>TAAQDDAGGRAQRWLGTKRYRASAAVLAGGGTSAGLQSIDGTVRGI<br>RFSHVWVQACVPHGAYRGARAEAGGYRWLALDAAVKDHDYQQGI<br>AVDVPLTDAAFYTPYLAARSDQLPHEHFAQKVAEAARATDANAALA<br>DVPYAGTPRPLRYDVLPGSLPYEVEAFTNWPGLGSSETASLPDAHRH<br>TFTVTVRNGATTLASAALPYPQNAFKRVTLSYQPTAASQAAWNAWT<br>GDLPAAADGSIQVVPQIKADGTVLAAGAPANALPLAGVHNVILKVSQ<br>GERSGAACINDSGNPADPKDTDGTCLNKTVYTNIKAGAYHALGLNA<br>LHTSNAFLGQRLEALAAGVQAYPVAPTPAAGAGYEATVGELLHLVL<br>QDYLHQTEQADQRNAALRGFKSVGPYDLGLTASDLETDYLFDIPVAI<br>KPAGVFVDFKGGLYGFVKLDTTAETAAARAAENVDLAKLSIYSGSAL<br>EHHVWQQALRTDAVSTVRGLQFAAEQGIPLVTFTAANIGQYDSLMQ<br>MSGATSMAAYKSAIQNAVKGSDNGNHGVVTVPRAQIAYADPVDPAS<br>KWTGAVYMSQNPVTGEYGAIINGTIAGGFPLLNSTPFSNLYNFDSFVP<br>NTLLGTNGGAGAVQTLPGGTQGESSWITKAGDPVNMLTGNYTLQAR<br>DFTIKGRGGLPIVLERWFNAQNATDGPFGFGWTHSFNHQLRFYGIESG<br>QSKVGWVDGTGAQRFYAVAAAGSIAPGTTLAAQAGVFTTLSRLADG<br>RFQVRETNGLTYSFESLTSPTTPPAAGSEPRARLLAIADRHGNTLTLNY<br>SGSQLASVSDSLGRTVLSFTWNGNRIGKVKDVSGREVNYAYEDGNG<br>NLTRVTDPLGQATRYSYYTSADGAKLDHALRRHTLPRGNGMEFEYY<br>AGGQVFRHTPFDTSGNLIPESALTFHYNSYRRESWTVDGRGAEERFLF<br>DTHGNVIQQTAANGATHTYAYADPNDPHLRTRMTDPVGRVTQYSYT<br>AEGYLQTLTLPSGAVQAWRDYDAFGQPRRVKDARGNWTLHHYDTA<br>GTRTDSIRVKSGVVPTVGTAPAAANVVSWIKYQGDSVGNLTGVKRL<br>RDWTGATLGNFASGSGPVVTTTFDAARLNVASVGRSGNRNGSQISET<br>SPIFSHDALGRLTGGVDGRWYPVAFDYDVLDRVTRATDATGQPRRY<br>AFDVNGNRIGTELIAGGSRIDSSVAAFDVQDRVAHVLDHAGNRVAYA<br>YDAVGNRVSVESPDGYAIGFDYDLAGRPYSAYDEDGNRVFSAFDVA<br>GRVRAVIDPNGAATLYDYHGDEQDGRLARVEQPAIPGQNAGRAAET<br>DYDAGGLPIRVRQVSAGGEAREGYRFHDELGRVVRSVSAPDDVGQR<br>LQVCYSYDALSNLTQVRAGATTDTTSAACAGSPAVQLTQSWDDFGN<br>LLTRTDALGRVWKFEYDAHGNLVASQTPEQAKVSTRSTYRYDPALH<br>GLLAGRSVPGSGSAGQSVSYARNALGQVIRAETRDGAGNLVVAYDY<br>QYDAAHRVVRIVDSRGGKALDYAWTPAGRLASITLDGHVWRFQYD<br>GVGRLAAIVAPNGATIAMARDAAGRLTERRWPDGAKSAFDWLPEGS<br>LAAIEHSAGGSALAQFAYAYDAWGNRTSATETLAGTSRSLAYGYDA<br>LDRLKTVTTDGATETHAFDLFGNRTSKTTGGVTTDYLFDAAHQLTQV<br>QIAGTPTERLAYDDNGNLRKHCVGSPSGSTSDCTGTTVLSLAWNGLD<br>QLIQAARTGLPAESYAYDDAGRRVTKAVGSSATHFAYDGPDILAEYA<br>SPAGSPTAVYAHGAGIDEPLLRLTGATSTPAASAHHYAQDGLGSIVA<br>AYGEIGASGPVSAASVSATHSYSAGSYPPAKLIDGETTGSTGFWAGSS<br>GNFAADPAVITLELGAEKSVSRVRLHRVASYLPDYVVKDAEVQVRKP<br>DNSWQTVGTLTNNTSEDSPEIVLTGAPGSALRVLVKGVRNGSLVLMA<br>EVTMSADGGAASVATARYDAWGNVTQASGSIPAFGYTGREPDATGL<br>VYYRARYYHPALGRFASRDPLGLAAGINPYAYAGGNPILYNDPDGLL<br>AQLAWNTAASYWGQPIVQETVATIRNGAAVAAGNFVPDTVNGATG<br>WFEQFLHQESGSFGRMDSWVDVRNPVAQDVAQDLRGVAAVGLMM<br>TPLRYGRASNASFNPPVANLPLNTGGKTSGMLHIPGQESLSLTSGIAGP<br>SQVVRGQGLPGFNGNQLTHVEGHAAAYMRTHKVSEAVLDINKAPCT<br>AGSGGGCNGLLPRMLPEGAHLTIRHPNGVQVYIGTPD [SEQ ID NO:<br>142] |
| DddA homolog in *Thauera* sp. K11 DNA | >CCZ27_07525 NZ_CP023439.1: 1708666-1716450 *Thauera* sp. K11<br>chromosome, complete genome<br>ATGCGTGCCTTCCGCCTGATCGCCTGCCTTCTCGCCTTTTCGGCGG<br>CAGCCGCACCTGCTGCGGCTGACACGTCGTCGATGCTGGGGCGTC<br>TGCCTGAAGCAAGCGCCCGCCAGCTCAAGGAGCGGTTGGCGCCGC<br>GTGGCCTTGCCTCCGCTGCCGCCTTGCGCCAGTACCTGGACGCCTC<br>GCAACGCGAGCTGGACACCGCACCGGAAGCGGACGACGTACCCG<br>CCCGCAGCCAACGCTTTGCCGCAAGGGCGGGCGAACTCACCGCGC<br>TGCGCGAACAGGCGCGCCGGGATCTCGCCAGTCTGGAGGACGCCG<br>CGAAGGCGAGCGGCTCGGCCGAGGCGACGCAGCGCATCGGTCGA<br>ATCCGCGGGCAGGTGGACGCACGCTTCGACCGGCTCGAAGGGCTT |

-continued

| DddA Description | DddA amino acid and/or nucleotid sequence |
|---|---|
| | TTTACCACTTGGCGCAATGCGCCCCAGGGCAGCGAACGCCGCCAG<br>GCCCGCCGCGAACTGCGTGCCGCGCTCGCCACGCTCCGCCATGCC<br>GGCACCCCGGCTCCGGCTGCGATTCCTGTTCCTACCCTCGGCCCCC<br>TGCAACCGGCCGGCGAGCCGGCTGCCAACCCACCGGCCGCGCGCT<br>TGCCAGCCTATGCGCAAGCGGATGACGCGACTGGCGACCCCTTTA<br>CCCCCGGTGGCTTCCGGCTGATGAAGGTCGCCGCACTGCCGCCGG<br>CGGTCGCGGCCGAGGCGGCAACGGACTGCTCCGCCACCAGCGCCG<br>ACCTGGCCGACGACGGCAAGGACGTGCGCCTGACCCAGCCGATCC<br>GCGACCTCGCGGCATCGCTCGACTACTCACCGGCACGCATCCTGC<br>GCTGGACGCAGCAGAACGTCGCCTTCGAACCCTACTGGGGGGCAC<br>TCAAGGGGGCGGAAGGCGTGCTGCAGACGCGCGCCGGCAACAGC<br>ACCGACCAGGCCAGCCTGCTGATCGCACTCTTGCGGGCCTCCAAC<br>ATTCCCGCCCGCTACGTACGCGGCACCGTGCAGCTCAACGACACT<br>GCCGCGCAGGACGACGCAGGCGGGCGGGCGCAGCGCTGGCTGGG<br>CACCAAGCGCTACCGTGCATCGGCCGCGGTACTCGCCGGCGGCGG<br>AACTTCCGCCGGCCTGCAGTCGATCGACGGCACCGTCCGCGGCAT<br>CCGCTTCAGCCATGTCTGGGTCCAGGCCTGCGTTCCCCATGGCGCT<br>TACCGCGGTGCCCGCGCGGAAGCCGGCGGCTATCGCTGGCTGGCG<br>CTGGACGCGGCGGTGAAGGACCATGACTACCAGCAGGGCATCGCG<br>GTCGATGTGCCGCTCACCGATGCCGCGTTCTACACGCCCTATCTGG<br>CGGCGCGCAGCGACCAGTTGCCGCACGAGCATTTCGCACAGAAGG<br>TGGCGGAGGCGGCGCGTGCGACCGACGCCAATGCGGCGCTGGCCG<br>ACGTGCCCTACGCCGGTACGCCGCGGCCGCTGCGCTACGACGTGC<br>TGCCCGGTTCGCTGCCCTACGAGGTCGAAGCCTTCACCAACTGGCC<br>CGGCCTCGGTTCGTCCGAAACCGCAAGCCTGCCGGACGCACACCG<br>CCACACCTTCACCGTGACGGTCAGGAACGGCGCCACCACGTTGGC<br>GAGCGCCGCGCTGCCCTATCCGCAGAACGCCTTCAAGCGCGTCAC<br>GCTGTCCTATCAGCCGACTGCCGCCTCGCAGGCGGCCTGGAACGC<br>CTGGACGGGCGATCTGCCCGCCGCGGCCGACGGCAGCATCCAGGT<br>CGTGCCGCAGATCAAGGCCGACGGTACCGTGCTCGCCGCAGGTGC<br>GCCCGCCAACGCGCTGCCGCTCGCCGGCGTGCACAACGTCATCCT<br>CAAGGTCTCGCAGGGCGAGCGCAGCGGTGCCGCGTGCATCAACGA<br>CAGCGGCAACCCCGCCGACCCGAAGGACACCGACGGCACCTGCCT<br>CAACAAGACCGTCTACACCAACATCAAGGCCGGCGCCTACCACGC<br>CCTGGGCCTGAATGCGCTGCACACCTCGAATGCCTTCCTCGGCCAG<br>CGGCTCGAAGCGCTGGCGGCCGGCGTGCAGGCCTATCCCGTCGCG<br>CCCACGCCGGCCGCGGGTGCCGGCTACGAGGCCACGGTCGGTGAA<br>TTGCTGCATCTGGTGCTGCAGGACTACCTGCACCAGACCGAGCAG<br>GCCGACCAGCGCAACGCCGCGTTGCGCGGCTTCAAGAGCGTGGGG<br>CCGTACGACCTCGGGCTGACCGCGTCCGACCTCGAAACCGACTAC<br>CTCTTCGACATCCCGGTCGCGATCAAGCCGGCCGGCGTGTTCGTGG<br>ACTTCAAGGGCGGCCTCTACGGTTTCGTCAAACTCGATACCACGGC<br>CGAGACGGCCGCGGCACGCGCCGCCGAAAACGTGGATCTGGCCAA<br>GCTCTCGATCTACTCCGGCTCCGCGCTCGAACACCACGTCTGGCAG<br>CAGGCGCTGCGCACCGATGCGGTGTCCACCGTGCGTGGGCTGCAG<br>TTCGCCGCCGAGCAGGGCATTCCGCTCGTCACCTTCACCGCGGCCA<br>ACATCGGCCAGTACGACAGCCTCATGCAGATGAGCGGCGCCACCA<br>GCATGGCCGCTTACAAGAGCGCGATCCAGAACGCGGTGAAGGGCT<br>CGGACAACGGCAACCACGGCGTCGTCACCGTGCCGCGCGCCCAGA<br>TCGCCTACGCCGACCCCGTCGATCCGGCGAGCAAATGGACCGGCG<br>CGGTCTACATGTCTCAGAACCCCGTCACCGGAGAGTACGGGGCGA<br>TCATCAACGGCACCATCGCCGGCGGCTTCCCGCTGCTCAACAGCA<br>CGCCCTTCAGCAATCTCTACAACTTCGATTCCTTCGTGCCCAACAC<br>CCTCCTTGGCACGAACGGGGGTGCCGGTGCGGTGCAGACCCTGCC<br>CGGCGGCACCCAGGGCGAGAGTTCCTGGATCACCAAGGCCGGCGA<br>CCCGGTGAACATGCTCACCGGCAACTACACGCTGCAGGCACGCGA<br>CTTCACCATCAAGGGCCGGGGCGGACTGCCGATCGTGCTGGAGCG<br>CTGGTTCAACGCGCAGAACGCCACCGACGGGCCGTTCGGCTTCGG<br>CTGGACGCACAGCTTCAACCATCAGTTGCGTTTCTACGGCATCGAG<br>AGCGGCCAGTCCAAGGTCGGCTGGGTGGACGGCACTGGCGCCCAG<br>CGCTTCTACGCCGTGGCCGCCGCCGGCAGCATTGCGCCGGGCACG<br>ACGCTGGCCGCGCAGGCCGGGGTGTTCACGACGCTGTCGCGTCTG<br>GCCGACGGCCGCTTCCAGGTGCGCGAGACCAACGGCCTCACCTAC<br>AGCTTCGAATCGCTCACGAGCCCGACCACCCCGCCGGCCGCGGGC<br>AGCGAACCGCGCGCAAGACTGCTGGCCATCGCCGACCGCCACGGC<br>AACACCCTGACGCTCAACTACAGCGGCAGCCAGCTTGCCTCGGTG<br>AGCGACAGCCTCGGCCGCACGGTGCTCAGCTTCACCTGGAACGGC<br>AACCGCATCGGCAAGGTGAAGGACGTCAGCGGACGGGAAGTGAA<br>CTACGCCTACGAGGACGGCAACGGCAACCTCACGCGCGTCACCGA<br>TCCGCTGGGTCAAGCCACGCGCTACAGCTACTACACCAGTGCCGA<br>CGGTGCCAAGCTCGACCACGCCCTGCGCCGCCACACCCTGCCGCG<br>CGGCAACGGCATGGAGTTCGAGTACTACGCCGGTGGCCAGGTCTT<br>CCGCCACACGCCGTTCGACACCAGCGGCAACCTCATTCCCGAATC<br>GGCGCTGACCTTCCACTACAACAGTTATCGGCGCGAGAGCTGGAC<br>GGTCGATGGCCGCGGTGCCGAGGAGCGCTTCCTGTTCGACACGCA<br>CGGCAACGTGATCCAGCAGACCGCCGCCAACGGTGCCACCCACAC |

-continued

| DddA Description | DddA amino acid and/or nucleotid sequence |
|---|---|
| | CTACGCGTACGCCGACCCGAACGATCCGCATCTGCGCACGCGCAT<br>GACAGACCCGGTCGGCCGCGTCACCCAGTACAGCTATACCGCCGA<br>AGGCTATCTGCAGACCCTGACGCTGCCGTCGGGCGCCGTGCAGGC<br>GTGGCGCGACTACGACGCCTTCGGCCAGCCCCGCCGCGTCAAGGA<br>CGCGCGCGGCAACTGGACGCTCCACCACTACGACACCGCCGGGAC<br>ACGGACCGACTCCATCCGGGTCAAATCGGGCGTGGTCCCCACCGT<br>CGGCACCGCGCCTGCCGCGGCCAACGTCGTTTCCTGGATCAAGTA<br>CCAGGGCGACAGCGTGGGCAACCTCACCGGCGTCAAGCGCCTGCG<br>CGACTGGACGGGCGCGACCCTGGGCAATTTCGCCAGCGGCAGCGG<br>CCCCGTCGTCACCACCACCTTCGATGCGGCCAGGCTCAACGTCGCC<br>AGCGTCGGCCGTAGCGGCAACCGCAACGGCAGCCAGATCAGCGA<br>GACCAGCCCGATCTTCTCCCACGACGCGCTGGGGCGCCTCACCGG<br>CGGGGTGGACGGGCGCTGGTATCCGGTCGCCTTCGATTACGACGT<br>GCTCGACCGCGTCACCCGCGCCACCGACGCCACGGGCCAGCCGCG<br>CCGCTACGCGTTCGACGTCAACGGCAACCGCATCGGTACGGAGCT<br>GATTGCCGGCGGCAGCCGTATCGATTCCTCGGTGGCCGCCTTCGAC<br>GTGCAGGACCGCGTCGCCCACGTCCTCGATCACGCCGGCAACCGC<br>GTGGCCTACGCCTACGATGCGGTGGGCAACCGGGTGAGCGTGGAA<br>AGCCCCGACGGCTACGCCATCGGCTTCGACTACGACCTCGCCGGA<br>CGGCCCTATTCGGCCTACGACGAAGACGGCAACCGCGTCTTCTCC<br>GCCTTCGACGTGGCCGGGCGCGTGCGAGCGGTCATCGACCCCAAC<br>GGCGCCGCGACGCTCTACGACTATCACGGCGACGAGCAGGACGGG<br>CGTCTCGCGCGCGTGGAGCAGCCCGCCATCCCGGGCCAGAACGCG<br>GGCCGCGCCGCCGAGACCGACTACGATGCGGGTGGGTTGCCCATC<br>CGCGTGCGCCAGGTCTCGGCCGGCGGCGAAGCGCGCGAAGGCTAC<br>CGTTTCCACGACGAGCTTGGCCGCGTGGTGCGCAGCGTCTCCGCGC<br>CGGACGACGTCGGCCAGCGGCTGCAGGTCTGCTACAGCTACGATG<br>CACTCTCGAACCTCACCCAGGTGCGCGCCGGCGCCACCACCGACA<br>CCACCAGTGCCGCCTGCGCCGGCAGCCCCGCGGTGCAGCTCACCC<br>AGAGCTGGGACGACTTTGGCAACCTGCTGACGCGCACCGACGCGC<br>TGGGCCGGGTGTGGAAGTTCGAGTACGACGCCCACGGCAACCTCG<br>TCGCCAGCCAGACGCCCGAGCAGGCCAAGGTCTCGACGCGCAGCA<br>CCTACCGCTACGATCCGGCGCTGCACGGCTTGCTGGCCGGGCGCA<br>GCGTGCCGGGCAGCGGCAGTGCGGGCCAGAGCGTGAGCTATGCGC<br>GCAACGCGCTCGGCCAGGTCATCCGCGCCGAGACGCGCGACGGCG<br>CGGGCAACCTCGTCGTCGCCTACGACTACCAGTACGACGCCGCCC<br>ACCGTGTGGTGCGCATCGTCGACAGCCGCGGCGGCAAGGCGCTCG<br>ACTACGCCTGGACGCCCGCCGGGCGGCTGGCGAGCATTACCCTGG<br>ACGGCCATGTCTGGCGCTTCCAGTACGACGGCGTCGGCCGGCTCG<br>CCGCGATCGTCGCGCCCAACGGCGCCACCATAGCGATGGCACGCG<br>ATGCCGCCGGGCGGCTCACCGAGCGGCGCTGGCCCGACGGCGCGA<br>AGAGCGCCTTCGACTGGCTGCCCGAAGGCAGCCTCGCCGCCATCG<br>AGCACAGCGCGGGCGGCAGCGCGCTCGCACAGTTCGCCTATGCCT<br>ACGATGCCTGGGGCAACCGCACGAGCGCCACCGAGACCCTCGCGG<br>GCACCAGCCGCAGCCTCGCCTACGGCTACGACGCGCTCGACCGCC<br>TGAAGACCGTCACCACCGACGGTGCGACCGAAACCCATGCCTTCG<br>ATCTCTTCGGCAATCGCACCAGCAAGACCACGGGCGGGGTGACCA<br>CCGACTATCTCTTCGACGCGGCGCACCAGCTCACCCAGGTGCAGA<br>TCGCCGGCACCCCCACCGAGCGGCTCGCCTACGACGACAACGGTA<br>ATCTCCGCAAGCACTGCGTCGGCAGTCCGAGTGGCAGCACCAGCG<br>ATTGCACCGGCACCACCGTGCTGAGCCTCGCCTGGAACGGCCTCG<br>ACCAGTTGATCCAGGCCGCCAGGACGGGCCTGCCCGCCGAGTCCT<br>ACGCCTACGACGATGCCGGGCGGCGTGTCACCAAGGCGGTGGGCA<br>GCAGCGCCACCCACTTCGCCTACGACGGTCCCGACATCCTGGCCG<br>AGTACGCCAGCCCGGCCGGCAGCCCCACCGCCGTCTATGCCCACG<br>GTGCCGGCATCGACGAACCGCTGCTGCGCCTCACCGGCGCGACGA<br>GCACGCCGGCCGCTTCCGCGCACCACTACGCGCAGGACGGGCTGG<br>GCAGCATCGTCGCGGCCTATGGCGAGATCGGCGCCAGCGGTCCGG<br>TCAGTGCCGCGAGCGTATCGGCCACCCACAGTTACAGCGCCGGCA<br>GCTACCCGCCGGCAAAGCTGATCGACGGCGAGACGACCGGAAGC<br>ACCGGGTTCTGGGCTGGCAGCTCGGGCAACTTCGCTGCCGATCCA<br>GCCGTGATCACGCTGGAACTGGGTGCGGAGAAAAGCGTGAGCCGC<br>GTGAGGCTGCACCGGGTGGCCAGCTACCTGCCCGACTACGTGGTC<br>AAGGATGCCGAGGTGCAGGTCCGAAAACCGGACAATTCGTGGCAG<br>ACGGTCGGCACGCTGACAAACAACACCAGCGAAGACAGTCCCGA<br>GATCGTGCTCACCGGCGCCCCCGGCAGCGCGCTGCGCGTGCTCGT<br>CAAGGGCGTGCGCAACGGCAGCCTGGTGCTGATGGCCGAGGTGAC<br>GATGAGTGCGGACGGTGGCGCGGCCAGCGTGGCCACCGCCCGCTA<br>CGACGCCTGGGGCAACGTCACGCAGGCGAGCGGCAGCATCCCGGC<br>CTTCGGCTACACCGGACGCGAGCCCGATGCCACGGGCCTGGTCTA<br>CTACCGCGCCCGCTACTACCACCCCGCGCTCGGCCGCTTCGCCAGC<br>CGCGACCCGCTGGGGCTGGCGGCGGGGATCAATCCCTACGCCTAC<br>GCGGGCGGCAATCCCATCCTCTACAACGATCCGGATGGCTTGCTG<br>GCGCAACTGGCGTGGAATACGGCGGCCAGCTACTGGGGACAGCCG<br>ATAGTTCAAGAAACGGTCGCCACGATTCGAAATGGGGCCGCAGTG<br>GCCGCTGGCAACTTCGTTCCAGACACGGTCAACGGTGCAACAGGT |

-continued

| DddA Description | DddA amino acid and/or nucleotid sequence |
|---|---|
| | TGGTTTGAGCAGTTCCTGCACCAAGAATCGGGCTCGTTCGGGCGC<br>ATGGACTCGTGGGTGGATGTGCGAAACCCCGTTGCGCAGGACGTA<br>GCCCAGGACCTGCGCGGTGTCGCAGCCGTTGGGTTAATGATGACG<br>CCGCTGCGGTATGGTCGTGCCTCCAACGCGTCTTTCAATCCGCCAG<br>TAGCCAATCTTCCGCTCAACACTGGAGGAAAAACATCTGGCATGT<br>TGCACATTCCAGGGCAAGAATCACTGTCGCTCACGAGCGGAATTG<br>CGGGGCCGTCTCAAGTCGTTAGAGGTCAAGGTTTGCCAGGATTCA<br>ACGGTAATCAGTTGACCCATGTGGAAGGTCATGCTGCTGCTTACAT<br>GCGGACTCACAAGGTCTCTGAGGCTGTTCTGGACATAAACAAAGC<br>ACCTTGCACCGCTGGTAGTGGTGGTGGATGTAATGGGTTGCTTCCC<br>CGAATGCTGCCGGAGGGGGCTCATTTAACAATTCGACACCCAAAT<br>GGTGTTCAAGTTTATATTGGCACTCCTGACTAA [SEQ ID NO: 143] |
| *Chondromyces crocatus* PROTEIN | >AKT41505.1 type IV secretion protein Rhs [*Chondromyces crocatus*]<br>MSMSASRSQPAFPFVSASSPRPRRRPPFPRALLLLIAVLLVGACGDAG<br>GPLLWSSSSQALWEPSPIPPLPPLLCLGPGDGPSPFPPDLTQGTTAAG<br>TLPGSFSVTSTGEATYTIPVPTLPGRAGIEPSLAITYDSAQGEGLLGIGF<br>HLQGLSSVDRCPRNVAQDGHIAPVRDAEDDALCLDGQRLVPVDPQP<br>GRAPREYRTFPDSFTRVEADFAESEGWPAERGPKRLRAHGKAGLIYE<br>YGGESSGRVLAQGEAVRSWLLTRLSDRDGNTMAVVYRNDLHAKGY<br>TVEHAPQRITYTRHPTVPASRMVEFTYGPLEAADVRVHYARGMELRR<br>SLSLRSIQMFGPGHVLARELRFGYGHGPATGRLRLEAVRECAGDGTC<br>KPPTRFTWHTAGAAGYTQQQTLVEVPLSERGTLMTMDVSGDGLDDL<br>VTSDMVVEAGTEEPITRWSVALNRSQELTPGFFEAAVTGQEQPHFIDA<br>EPPYQPELGTPLDYDHDGRMDLFLHDVHGQSMTWEVLLSNGDGRFT<br>RRDTGVPRPFTMGMTPAGLRSPDASTHLVDVDGDGMVDLLQCYLSA<br>HEQLWYLHRWTAAAGGFAPHGDRVHALSSYPCHAELHAVDVDADG<br>RVDLVMQELILVGSQVRAGWQYVAFSYELSDGSWTRALTGLRLTPP<br>GDRVFFLDVNGDGLPDAVQSSRDDEQLYTSMNIGAGFAAPVPSLATP<br>TLGAARFVRFASVLDHNADGRQDLLLAMSDGGSESLPAWKVLQATG<br>EVGPGTFEIVHPGLPMGIVLQQDELPTPDHPLTPRVTDVNGDGAQDLL<br>YAFNNQVHVFENVLGQEDLLAAVTDGMNAHAPEDAEYLPNVQIRYD<br>HLIDRARTTEGFEDAPGIPSPEQRTYRPLEQSDEEPCRYPVRCVVGHR<br>RVVSGYVLNNGADRPRTFQVAYRNGRHHRLGRGFLGFGTRIVRDLD<br>TGAGTAEFYDNVTFDGAFQAFPFRGQVQRSWRWSPSLPLDAHSAEPA<br>SLELLTTRSYAVVIPTQAGTYFTLSLLEGKSRHQGTFSPGSGKTLEEAV<br>RALEGDLASRMSDTLRTVSDFDLYGNILAEQTQTEGVDLDLSVTRSF<br>DNDPLSWRLGELTRETTCSKAGGETQCRVMHRSYDGRGHVRLERVG<br>GEPFDPEMQLDVWFSRDALGNIHSTRSRDGTGQVRASCTSYDALGL<br>MPYAHRNLEGHQSYTRYDPAVGVLRASVDPNGLVSRWAYDGFGRV<br>TLESLPGRMPTVIRRTWTKDGGAAGNAWNLKIRTASVGGQDETVQL<br>DGLGREVRWWWQALDVGEEQAPRMMQEVAFDARGEHLAWRSLPI<br>VDPAPPGSVQVRETWQYDGMGRVLRHVTPWGAATTHEYIGRDEVIT<br>APGQAVTRIASDPLGRPTAVGDPEGGVSRYTYGPFGGLREVTTPAGA<br>VTLTERDAFGRVRRQVSPDRGVSTAHYDGYGQKISSLDAAGRAVTTR<br>YDTLGRIFRQVDEDGVTEFRWDDAQHGVGQLALVVSPDGHRLRYGF<br>DHLGRPATTTLEIGGESFTSRLSYDLSGRLERIEYPSAPGIGSFAIEREY<br>DPHGRLRALKDAGSGAEFWRATAIDAGNRITGERFGGGTATTLRTFD<br>AARERVSRIETQTAGGPVQQLSYLWNDRRKLVERSDGLHANVERFR<br>YDLLDRLTCAQFGLINAALCERPFTYGPDGNLLQKPGVGAYEYDPAQ<br>PHAVVRAGSAFYGYDAVGNQTSRPGATIAYTAFDLPKRIALTSGDTV<br>DFAYDGLQQRVRKTTATQEIASFGEVYERVTDVVTGAVEHRYHVRN<br>DERVVTLVRRSVAQGTRTLHVHVDHLGSIDVLTDGVTGSVAERRSY<br>DAFGAPRHPDWGSGQPPSPHELSSLGFTGHEADLDLGLVNMKGRIYD<br>PKLGRFLTPDPLVPRPLFGQSWNSYSYVLNSPLSLVDPSGFQEQPPATE<br>DGCSQGCTIWVFGPPREPKPPAPPKVVEGNLEDAAGTGSTQAPVDVG<br>TSGVRSGWSPQLPATLQTLGRGDAIARRIMDGVRIGMARMLLESAKL<br>GILGGTSRVYVAYTNLTAAWNGYKESGLPGALDAVNPASQMVQAG<br>VEAYEAAAAEDWEAAGASLFKAGSIGMSILATAVGVGGAITATVGST<br>AGAAGRAAARAPSLPAYAGGKTSGVLRTTAGDTALLSGYKGPSASM<br>PRGTPGMNGRIKSHVEAHAAAVMREQGMKEGTLYINRVPCSGATGC<br>DAMLPRMLPPDAHLRVVGPNGYDQVFVGLPD [SEQ ID NO: 144] |
| *Chondromyces crocatus* DNA | >CMC5_057130 NZ_CP012159.1: 7808731-7815414 *Chondromyces crocatus* strain Cm c5, complete genome<br>ATGTCCATGTCGGCCTCACGGAGTCAGCCCGCATTCCCCTTCGTGT<br>CGGCCTCCTCTCCGCGTCCGCGCCGGCGCCCTCCCTTTCCCCGAGC<br>GCTGCTCCTCCTCATCGCCGTGCTCCTCGTCGGCGCATGCGGCGAC<br>GCTGGCGGCCCGCTTCTCTGGTCGAGCAGCTCCCAGGCCCTCTGGG<br>AACCCTCCCCGATCCCGCCGCTCCCCCCGCTCCTGTGCCTCGGCCC<br>CGGCGACGGTCCCTCCCCCTTTCCGCCTGACCTTACGCAGGGGACC<br>ACCACCGCGGCGGGGACCCTGCCAGGGAGCTTTTCGGTCACGAGC<br>ACGGGCGAGGCGACGTACACGATCCCGGTCCCCACGCTGCCTGGC<br>CGTGCCGGCATCGAGCCCTCGCTGGCGATCACCTACGACAGTGCG<br>CAGGGTGAAGGGCTGCTCGGGATCGGCTTCCACTTGCAGGGCCTC<br>TCGTCGGTCGATCGCTGCCCCCGGAACGTCGCGCAGGATGGTCAC |

-continued

| DddA Description | DddA amino acid and/or nucleotid sequence |
|---|---|
| | ATCGCGCCGGTCCGGGATGCCGAGGACGACGCCTTGTGCCTCGAT<br>GGGCAGCGGCTCGTCCCCGTGGACCCGCAGCCAGGGCGTGCGCCG<br>CGGGAATACCGCACGTTCCCGGACAGCTTCACGCGCGTCGAGGCC<br>GACTTCGCGGAGAGCGAGGGGTGGCCGGCGGAGCGTGGGCCGAA<br>GCGGCTGCGGGCGCATGGCAAAGCGGGGCTGATCTACGAATACGG<br>TGGAGAATCATCGGGCCGGGTGCTCGCGCAAGGGGAGGCGGTGCG<br>GTCCTGGTTGCTGACGCGGCTCAGCGACCGGGATGGCAACACGAT<br>GGCGGTGGTCTACCGGAATGACCTCCACGCGAAGGGCTACACCGT<br>CGAGCACGCGCCGCAGCGGATCACCTACACCAGGCACCCGACTGT<br>GCCGGCCTCGCGCATGGTGGAGTTCACGTACGGGCCGCTGGAGGC<br>GGCGGACGTGCGCGTACACTATGCCCGCGGGATGGAGCTGCGCCG<br>CTCGCTGAGCTTGCGCTCGATCCAGATGTTCGGGCCGGGACACGT<br>GCTCGCGAGGGAGCTGCGCTTCGGTTACGGGCATGGGCCGGCGAC<br>GGGTCGCTTGCGACTGGAGGCGGTTCGGGAGTGCGCAGGTGACGG<br>GACGTGCAAGCCGCCGACACGCTTCACCTGGCACACGGCCGGAGC<br>GGCTGGATACACGCAGCAGCAGACACTGGTGGAGGTGCCGCTGTC<br>GGAGCGCGGCACGTTGATGACGATGGACGTCAGCGGCGATGGCCT<br>CGACGACCTGGTGACGTCCGACATGGTGGTGGAGGCCGGCACGGA<br>AGAGCCGATCACCCGCTGGTCGGTCGCGCTCAACCGGAGCCAGGA<br>GCTGACGCCGGGGTTCTTCGAGGCGGCCGTCACTGGGCAGGAGCA<br>GCCGCATTTCATCGACGCAGAGCCGCCGTACCAGCCGGAGCTGGG<br>GACGCCGCTCGACTACGACCACGATGGCCGGATGGACCTGTTTCT<br>GCACGATGTGCACGGGCAGTCGATGACGTGGGAGGTGCTGCTGTC<br>GAATGGAGATGGGCGGTTCACGCGGCGGGATACGGGGGTGCCGC<br>GGCCGTTCACGATGGGCATGACGCCGGCGGGATTGCGCAGCCCGG<br>ATGCGTCGACCCATCTGGTGGATGTTGACGGTGACGGGATGGTGG<br>ACCTGCTGCAGTGCTACCTGAGCGCGCACGAGCAGCTCTGGTACTT<br>GCACCGCTGGACGGCAGCGGCGGGGGGCTTCGCGCCGCACGGCGA<br>TCGGGTGCATGCGCTGAGCTCCTACCCGTGCCACGCCGAGCTGCA<br>CGCGGTCGATGTCGACGCGGATGGGCGGGTGGACCTGGTGATGCA<br>GGAGCTGATCCTCGTCGGGAGCCAGGTGCGGGCGGGGTGGCAGTA<br>CGTGGCGTTCTCGTACGAGCTGTCCGATGGATCGTGGACGCGCGC<br>GCTGACGGGGCTGCGGCTCACGCCGCCTGGGGACCGGGTGTTCTT<br>CCTCGACGTCAACGGCGATGGGCTGCCCGATGCGGTGCAGAGCAG<br>CCGGGACGATGAGCAGCTGTACACGTCGATGAATATCGGCGCGGG<br>ATTCGCGGCGCCGGTACCGAGCCTGGCGACGCCGACGCTCGGGGC<br>TGCGAGGTTCGTTCGGTTTGCGTCGGTGCTCGATCACAACGCGGAT<br>GGGCGACAAGACCTGCTGCTGGCCATGAGCGATGGGGGATCGGAG<br>TCGCTGCCCGCGTGGAAGGTGCTCCAGGCGACGGGGGAGGTCGGT<br>CCGGGGACGTTCGAGATCGTCCATCCCGGGCTGCCGATGGGCATC<br>GTGCTCCAGCAGGACGAGCTGCCCACGCCCGACCATCCGCTCACG<br>CCGCGGGTCACTGACGTGAATGGGGATGGGGCGCAGGATCTGCTC<br>TATGCGTTCAACAACCAGGTCCATGTGTTCGAGAACGTGCTCGGCC<br>AGGAGGACCTGCTCGCGGCCGTGACCGACGGCATGAATGCGCACG<br>CTCCGGAGGACGCCGAGTACCTGCCCAACGTGCAGATCCGGTACG<br>ACCACCTGATCGATCGTGCGCGGACGACGGAGGGCTTCGAGGATG<br>CTCCAGGGATCCCGTCACCCGAGCAGCGCACCTACCGGCCTCTGG<br>AGCAAAGCGATGAGGAGCCCTGCCGCTATCCGGTGCGGTGCGTGG<br>TCGGGCATCGGCGGGTGGTGAGCGGCTATGTGCTCAACAATGGCG<br>CGGATCGGCCGCGCACCTTCCAGGTGGCCTACCGCAATGGCCGTC<br>ACCATCGCCTGGGCCGAGGGTTTCTGGGGTTCGGGACGCGGATCG<br>TGCGTGACCTCGATACCGGCGCGGGGACGGCCGAGTTCTACGACA<br>ACGTCACGTTTGATGGCGCCTTCCAGGCCTTCCCTTTCCGAGGGCA<br>GGTACAGCGCTCGTGGCGCTGGAGTCCGAGCTTGCCGCTGGACGC<br>GCATAGCGCGGAGCCGGCGTCCCTCGAGCTGCTGACGACGCGGAG<br>CTACGCGGTGGTGATCCCCACGCAAGCGGGGACGTACTTCACCCT<br>CTCGCTGCTGGAGGGCAAGAGCCGTCATCAGGGCACGTTCTCACC<br>GGGGAGTGGGAAAACGCTCGAAGAAGCCGTGCGCGCTCTGGAAG<br>GAGATCTCGCCTCGCGAATGAGCGACACGCTCCGCACCGTCAGCG<br>ACTTCGACCTCTACGGGAACATCCTCGCCGAGCAAACGCAGACGG<br>AGGGCGTCGACCTCGACCTCTCGGTGACGCGCAGCTTCGACAACG<br>ACCCGCTCTCCTGGCGCCTTGGCGAGCTGACGCGAGAGACGACGT<br>GCAGCAAAGCGGGCGGTGAGACGCAGTGCCGGGTGATGCACCGG<br>AGCTATGACGGGCGCGGCCACGTTCGCCTGGAGCGCGTCGGGGGA<br>GAGCCCTTCGACCCGGAGATGCAGCTCGATGTCTGGTTCTCGCGG<br>GACGCGCTGGGCAACATCCACAGCACCCGGTCACGTGATGGGACG<br>GGGCAGGTGCGCGCGAGCTGCACCAGCTACGACGCGCTGGGCTTG<br>ATGCCTTATGCCCACCGCAACCTGGAGGGCCACCAGAGCTATACG<br>CGCTACGACCCGGCCGTGGGCGTGCTGCGGGCGTCGGTGGATCCC<br>AACGGCCTGGTGAGCCGCTGGGCCTACGATGGCTTCGGGCGGGTG<br>ACGCTGGAGAGCCTCCCCGGGCGCATGCCCACCGTCATCCGGCGG<br>ACCTGGACGAAGGACGGCGGAGCGGCTGGCAACGCCTGGAACCT<br>GAAGATCCGCACCGCCTCGGTGGGGGGCCAGGACGAGACCGTGCA<br>GCTCGATGGTCTCGGGCGGGAGGTGCGCTGGTGGTGGCAAGCGCT<br>CGACGTGGGGGAAGAGCAAGCGCCGCGGATGATGCAGGAGGTCG<br>CCTTCGATGCGCGGGGCGAGCACCTCGCGTGGCGCTCGCTGCCGA |

-continued

| DddA Description | DddA amino acid and/or nucleotid sequence |
|---|---|
| | TCGTGGATCCCGCGCCACCAGGCTCGGTGCAGGTGCGAGAGACGT GGCAATACGACGGGATGGGGGGGTGCTCCGGCACGTCACGCCGT GGGGGGCGGCGACGACGCACGAGTACATCGGGCGGGACGAGGTC ATCACCGCGCCTGGGCAGGCCGTCACCCGAATCGCCAGCGATCCG CTCGGGAGGCCCACGGCAGTGGGTGATCCCGAAGGTGGCGTCAGC CGGTACACCTACGGTCCCTTCGGGGGGCTGCGCGAGGTGACCACG CCCGCTGGTGCCGTGACGCTGACCGAGCGGGATGCGTTTGGCCGC GTGCGACGGCAGGTGAGCCCGGACCGGGGAGTCTCTACTGCGCAC TACGACGGTTACGGGCAGAAGATCTCATCGCTCGACGCGGCAGGA CGCGCGGTCACGACCCGCTACGACACGCTGGGTCGGATTTTCAGG CAGGTCGACGAAGACGGCGTCACCGAGTTCCGTTGGGATGACGCG CAGCATGGAGTGGGTCAGCTCGCGCTGGTGGTCAGCCCCGATGGG CATCGGCTGCGCTACGGCTTCGACCACCTCGGGCGACCAGCGACG ACGACGCTGGAGATCGGAGGGGAAAGCTTCACCAGCCGGCTGTCT TATGATCTGAGCGGCCGGCTCGAGCGGATCGAGTACCCGAGCGCG CCGGGGATTGGCAGCTTCGCCATCGAGCGGGAGTACGATCCTCAC GGGCGGCTGCGGGCGCTGAAGGATGCGGGGTCGGGGGCGGAGTT CTGGCGAGCCACCGCGATCGATGCGGGGAATCGCATCACGGGGGA GCGCTTCGGTGGGGGGACCGCCACCACGCTCCGCACGTTCGACGC GGCACGGGAGCGGGTGAGTCGGATCGAGACGCAGACGGCAGGTG GGCCCGTCCAGCAGCTCTCCTACCTCTGGAACGATCGCCGCAAGCT CGTCGAGCGCTCCGATGGCCTCCACGCCAACGTCGAGCGCTTTCGT TACGACCTGCTGGACCGGCTGACGTGCGCGCAGTTCGGGCTGATC AATGCTGCCCTCTGCGAGCGACCGTTCACCTACGGACCCGACGGC AACCTGCTCCAGAAGCCCGGCGTCGGTGCCTACGAGTACGACCCC GCGCAGCCCCACGCCGTCGTCCGAGCTGGTAGCGCGTTCTACGGC TACGACGCCGTCGGCAACCAGACCTCACGACCCGGCGCGACCATC GCCTACACCGCGTTCGACCTACCGAAGCGAATCGCGCTCACCAGC GGCGACACCGTCGACTTCGCGTACGACGGCCTCCAGCAGCGGGTG CGCAAGACCACGGCGACGCAGGAGATCGCCTCCTTCGGCGAGGTG TACGAGCGCGTGACCGATGTCGTCACGGGAGCCGTCGAGCATCGC TACCACGTGCGCAACGACGAGCGCGTCGTCACGCTGGTGCGGCGC TCGGTCGCGCAAGGCACGCGCACGCTGCATGTCCATGTCGACCAC CTCGGGTCGATCGATGTGCTCACCGACGGTGTGACCGGCAGCGTC GCCGAGCGCCGCAGCTACGATGCCTTCGGCGCACCGCGCCATCCC GACTGGGGTTCGGGTCAGCCTCCGTCACCCCACGAGCTGTCGTCGC TTGGCTTCACCGGGCACGAGGCCGACCTCGACCTCGGCCTCGTGA ACATGAAGGGGCGCATCTACGACCCCAAGCTCGGACGGTTCCTCA CGCCCGATCCGCTCGTGCCGCGGCCTCTCTTCGGGCAGAGCTGGA ATAGCTATTCGTACGTGCTAAACAGCCCGCTGTCGCTGGTCGATCC CAGTGGGTTTCAAGAGCAGCCACCTGCGACAGAGGACGGATGCTC GCAGGGCTGCACCATCTGGGTGTTCGGTCCTCCCCGCGAGCCGAA GCCACCTGCGCCGCCCAAGGTCGTCGAGGGCAACCTGGAGGACGC CGCTGGCACTGGTTCGACCCAGGCGCCGGTCGATGTCGGGACCTC CGGGGTCCGTAGCGGATGGAGTCCGCAGCTCCCGGCCACGTTGCA GACCTTGGGCCGTGGTGACGCCATCGCCAGGCGCATCATGGACGG CGTCCGCATCGGGATGGCCAGGATGCTGCTGGAGTCCGCAAAGCT CGGCATCCTGGGCGGCACCAGCCGCGTCTACGTCGCCTACACCAA CCTCACCGCCGCCTGGAATGGCTACAAAGAGAGCGGGCTCCCCGG CGCTCTCGACGCCGTCAATCCCGCCAGCCAGATGGTCCAAGCCGG CGTGGAGGCCTACGAGGCTGCCGCCGCAGAGGACTGGGAGGCCGC CGGCGCCAGCTTGTTCAAGGCCGGGTCGATCGGGATGTCGATCCT GGCGACGGCTGTTGGCGTCGGGGGAGCGATCACTGCGACAGTGGG CTCGACGGCAGGAGCGGCGGGGAGGGCAGCCGCAAGAGCCCCCT CACTCCCTGCATATGCTGGCGGAAAAACGTCGGGAGTACTACGGA CCACCGCAGGCGATACAGCACTGCTGAGCGGCTACAAGGGGCCGT CCGCATCGATGCCTCGAGGAACGCCAGGCATGAACGGACGCATCA AGTCGCATGTAGAAGCTCATGCGGCTGCCGTGATGCGAGAGCAAG GGATGAAGGAAGGAACCCTGTACATCAATCGAGTCCCCTGCTCTG GCGCCACCGGATGCGACGCGATGCTCCCAAGAATGCTCCCACCAG ATGCACACCTTCGCGTGGTCGGTCCGAATGGTTACGATCAAGTTTT TGTCGGGCTGCCCGACTGA [SEQ ID NO: 145] |

In addition, the disclosure contemplates the use any variant of any DddA amino acid sequence, including:

| Mutation(s) | Sequence (relative to DddAtox or wildtype of SEQ ID NO: 338) | SEQ ID NO: |
|---|---|---|
| DddA (residues 1290-1427) or (DddAtox) | GSYALGPYQISAPQLPAYNGQTVGTFYYVNDAGGLESKV FSSGGPTPYPNYANAGHVEGQSALFMRDNGISEGLVFHN NPEGTCGFCVNMTETLLPENAKMTVVPPEGAIPVKRGAT GETKVFTGNSNSPKSPTKGGC | 338 |

-continued

| Mutation(s) | Sequence (relative to DddAtox or wildtype of SEQ ID NO: 338) | SEQ ID NO: |
|---|---|---|
| T1380I | GSYALGPYQISAPQLPAYNGQTVGTFYYVNDAGGLESKV FSSGGPTPYPNYANAGHVEGQSALFMRDNGISEGLVFHN NPEGTCGFCVNMIETLLPENAKMTVVPPEGAIPVKRGAT GETKVFTGNSNSPKSPTKGGC | 377 |
| T1314A/T1380I | GSYALGPYQISAPQLPAYNGQTVGAFYYVNDAGGLESK VFSSGGPTPYPNYANAGHVEGQSALFMRDNGISEGLVFH NNPEGTCGFCVNMIETLLPENAKMTVVPPEGAIPVKRGA TGETKVFTGNSNSPKSPTKGGC | 378 |
| Q1310R/ S1330I/ T1380I | GSYALGPYQISAPQLPAYNGRTVGTFYYVNDAGGLESKV FISGGPTPYPNYANAGHVEGQSALFMRDNGISEGLVFHN NPEGTCGFCVNMIETLLPENAKMTVVPPEGAIPVKRGAT GETKVFTGNSNSPKSPTKGGC | 379 |
| T1380I/T1413I | GSYALGPYQISAPQLPAYNGQTVGTFYYVNDAGGLESKV FSSGGPTPYPNYANAGHVEGQSALFMRDNGISEGLVFHN NPEGTCGFCVNMIETLLPENAKMTVVPPEGAIPVKRGAT GETKVFIGNSNSPKSPTKGGC | 380 |
| T1314A/T1380I/ E1396K | GSYALGPYQISAPQLPAYNGQTVGAFYYVNDAGGLESK VFSSGGPTPYPNYANAGHVEGQSALFMRDNGISEGLVFH NNPEGTCGFCVNMIETLLPENAKMTVVPPKGAIPVKRGA TGETKVFTGNSNSPKSPTKGGC | 381 |

mitoTALEs and mitoZFs

In various embodiments, the mtDNA base editors or the polypeptides that comprise the mtDNA base editors (e.g., the pDNAbps and DddA) may include a mitoTALE as the pDNAbp component.

MitoTALEs and mitoZFP are known in the art. Each of the proteins may comprise a mitochondrial targeting sequence (MTS) in order to facilitate the translocation of the protein into the mitochondria.

In one aspect, the methods and compositions described herein involve a TALE protein programmed (e.g., engineered through manipulation of the localization signal in the C-terminus) to localize to the mitochondria (mitoTALE). In some embodiments, the localization signal comprises a sequence to target SOD2. In some embodiments, the LS comprises SEQ ID NO.: 13. In some embodiments, the LS comprises a sequence to target Cox8a. In some embodiments, the LS comprises SEQ ID NO.: 14. In some embodiments, the LS comprises a sequence with 75% or greater percent identity (e.g., 80% or greater, 85% or greater, 90% or greater, 95% or greater, 96% or greater, 97% or greater, 98% or greater, 99% or greater, 99.5% or greater, 99.9% or greater percent identity) to SEQ ID NOs.: 13 or 14.

The mitoTALE is also used to guide the fusion protein to the appropriate target nucleotide in the mtDNA. By using the RVD in the mitoTALE specific sequences can be targeted, which will place the attached DddA proximal to the target nucleotide. As used herein, "proximal" or "proximally" with repect to a target nucleotide shall mean a range of nucleic acids which are arranged consecutively upstream or downstream of the target nucleotide, on either the strand containing the target nucleotide or the strand complementary to the strand containing the target nucleotide, which when targeted and bound by a mitoTALE allow for the dimerization or re-assembly of portions of a DddA to regain, at least partially, the native activity of a full length DddA. Accordingly, the sequence should be selected from a range of nucleotides at or near the target nucleotide, or the nucleotide complementary thereto. In some embodiments, the target nucleic acid sequence is located upstream of the target nucleotide. In some embodiments, the target nucleic acid sequence is between 1 and 40 nucleotides upstream of the target nucleotide. In some embodiments, the target nucleic acid sequence is between 5 and 20 nucleotides upstream of the target nucleotide.

In some embodiments, a second mitoTALE is used. A second mitoTALE can be used to deliver additional components (e.g., additional DddA, a second portion of a DddA, additional enzymes). In some embodiments, the second mitoTALE is configured to bind a second target nucleic acid sequence. In some embodiments, the second mitoTALE is configured to bind a second target nucleic acid sequence on the nucleic acid strand complementary to the strand containing the target nucleotide. In some embodiments, the second mitoTALE is configured to bind a second target nucleic acid sequence upstream of the nucleotide complementary to the target nucleotide, which complementary nucleotide is on the nucleic acid strand complementary to the strand containing the target nucleotide. In some embodiments, the second target nucleic acid sequence is between 1 and 40 nucleotides upstream of the nucleotide complementary to the target nucleotide, which is on the strand complementary to the strand containing the target nucleotide. In some embodiments, the second target nucleic acid sequence is between 5 and 20 nucleotides upstream of the nucleotide complementary to the target nucleotide, which is on the strand complementary to the strand containing the target nucleotide.

In some embodiments, a mitoTALE comprises an amino acid sequence selected from any one of the following amino acid sequences, or an amino acid sequence having at least 70%, 75%, 80%, 85%, 90%, 95%, or 99% sequence identity with any one of the following mitoTALE sequences:

| SEQ ID NO. | Sequence | Description |
|---|---|---|
| 1 | MALSRAVCGTSRQLAPVLGYLGSRQKHSLPDYPYDVPDYAGYPYDVPDY AGYPYDVPDYAMDIADLRTLGYSQQQQEKIKPKVRSTVAQHHEALVGHG FTHAHIVALSQHPAALGTVAVKYQDMIAALPEATHEAIVGVGKQWSGAR ALEALLTVAGELRGPPLQLDTGQLLKIAKRGGVTAVEAVHAWRNALTGA PLNLTPQQVVAIASNNGGKQALETVQRLLPVLCQAHGLTPEQVVAIASN IGGKQALETVQALLPVLCQAHGLTPEQVVAIASHDGGKQALETVQRLLP VLCQAHGLTPEQVVAIASHDGGKQALETVQRLLPVLCQAHGLTPEQVVA IASHDGGKQALETVQRLLPVLCQAHGLTPEQVVAIASHDGGKQALETVQ RLLPVLCQAHGLTPEQVVAIASHDGGKQALETVQRLLPVLCQAHGLTPE QVVAIASNIGGKQALETVQALLPVLCQAHGLTPQQVVAIASNGGGKQAL ETVQRLLPVLCQAHGLTPQQVVAIASNGGGRPALESIVAQLSRPDPALA ALTNDHLVALACLGGRPALDAVKKGLGGSGSYALGPYQISAPQLPAYNG QTVGTFYYVNDAGGLESKVFSSGGPTPYPNYANAGHVEGQSALEMRDNG ISEGLVFHNNPEGTCGFCVNMTETLLPENAKMTVVPPEG | Mito 24 |
| 2 | MALSRAVCGTSRQLAPVLGYLGSRQKHSLPDYPYDVPDYAGYPYDVPDY AGYPYDVPDYATNLSDIIEKETGKQLVIQESILMLPEEVEEVIGNKPES DILVHTAYDESTDENVMLLTSDAPEYKPWALVIQDSNGENKIKMLSGGS GGSGGSTNLSDIIEKETGKQLVIQESILMLPEEVEEVIGNKPESDILVH TAYDESTDENVMLLTSDAPEYKPWALVIQDSNGENKIKMLSGGSMDIAD LRTLGYSQQQQEKIKPKVRSTVAQHHEALVGHGFTHAHIVALSQHPAAL GTVAVKYQDMIAALPEATHEAIVGVGKQWSGARALEALLTVAGELRGPP LQLDTGQLLKIAKRGGVTAVEAVHAWRNALTGAPLNLTPQQVVAIASNN GGKQALETVQRLLPVLCQAHGLTPEQVVAIASNIGGKQALETVQALLPV LCQAHGLTPEQVVAIASHDGGKQALETVQRLLPVLCQAHGLTPEQVVAI ASHDGGKQALETVQRLLPVLCQAHGLTPEQVVAIASHDGGKQALETVQR LLPVLCQAHGLTPEQVVAIASHDGGKQALETVQRLLPVLCQAHGLTPEQ VVAIASHDGGKQALETVQRLLPVLCQAHGLTPEQVVAIASNIGGKQALE TVQALLPVLCQAHGLTPQQVVAIASNGGGKQALETVQRLLPVLCQAHGL TPQQVVAIASNGGGRPALESIVAQLSRPDPALAALINDHLVALACLGGR PALDAVKKGLGGSGSYALGPYQISAPQLPAYNGQTVGTFYYVNDAGGLE SKVFSSGGPTPYPNYANAGHVEGQSALEMRDNGISEGLVFHNNPEGTCG FCVNMTETLLPENAKMTVVPPEG | Mito 24a |
| 3 | MALSRAVCGTSRQLAPVLGYLGSRQKHSLPDYPYDVPDYAGYPYDVPDY AGYPYDVPDYAMDIADLRTLGYSQQQQEKIKPKVRSTVAQHHEALVGHG FTHAHIVALSQHPAALGTVAVKYQDMIAALPEATHEAIVGVGKQWSGAR ALEALLTVAGELRGPPLQLDTGQLLKIAKRGGVTAVEAVHAWRNALTGA PLNLTPQQVVAIASNNGGKQALETVQRLLPVLCQAHGLTPEQVVAIASN IGGKQALETVQALLPVLCQAHGLTPEQVVAIASHDGGKQALETVQRLLP VLCQAHGLTPEQVVAIASHDGGKQALETVQRLLPVLCQAHGLTPEQVVA IASHDGGKQALETVQRLLPVLCQAHGLTPEQVVAIASHDGGKQALETVQ RLLPVLCQAHGLTPEQVVAIASHDGGKQALETVQRLLPVLCQAHGLTPE QVVAIASNIGGKQALETVQALLPVLCQAHGLTPQQVVAIASNGGGKQAL ETVQRLLPVLCQAHGLTPQQVVAIASNGGGRPALESIVAQLSRPDPALA ALTNDHLVALACLGGRPALDAVKKGLGGSGSYALGPYQISAPQLPAYNG QTVGTFYYVNDAGGLESKVFSSGGPTPYPNYANAGHVEGQSALEMRDNG ISEGLVFHNNPEGTCGFCVNMTETLLPENAKMTVVPPEGSGGSINLSDI IEKETGKQLVIQESILMLPEEVEEVIGNKPESDILVHTAYDESTDENVM LLTSDAPEYKPWALVIQDSNGENKIKMLSGGSGGSGGSTNLSDIIEKET GKQLVIQESILMLPEEVEEVIGNKPESDILVHTAYDESTDENVMLLTSD APEYKPWALVIQDSNGENKIKML | Mito 24b |
| 4 | MALSRAVCGTSRQLAPVLGYLGSRQKHSLPDYPYDVPDYAGYPYDVPDY AGYPYDVPDYATNLSDIIEKETGKQLVIQESILMLPEEVEEVIGNKPES DILVHTAYDESTDENVMLLTSDAPEYKPWALVIQDSNGENKIKMLSGGS MDIADLRTLGYSQQQQEKIKPKVRSTVAQHHEALVGHGFTHAHIVALSQ HPAALGTVAVKYQDMIAALPEATHEAIVGVGKQWSGARALEALLTVAGE LRGPPLQLDTGQLLKIAKRGGVTAVEAVHAWRNALTGAPLNLTPQQVVA IASNNGGKQALETVQRLLPVLCQAHGLTPEQVVAIASNIGGKQALETVQ ALLPVLCQAHGLTPEQVVAIASHDGGKQALETVQRLLPVLCQAHGLTPE QVVAIASHDGGKQALETVQRLLPVLCQAHGLTPEQVVAIASHDGGKQAL ETVQRLLPVLCQAHGLTPEQVVAIASHDGGKQALETVQRLLPVLCQAHG LTPEQVVAIASHDGGKQALETVQRLLPVLCQAHGLTPEQVVAIASNIGG KQALETVQALLPVLCQAHGLTPQQVVAIASNGGGKQALETVQRLLPVLC QAHGLTPQQVVAIASNGGGRPALESIVAQLSRPDPALAALINDHLVALA CLGGRPALDAVKKGLGGSGSYALGPYQISAPQLPAYNGQTVGIFYYVND AGGLESKVFSSGGPTPYPNYANAGHVEGQSALFMRDNGISEGLVFHNNP EGTCGFCVNMTETLLPENAKMTVVPPEG | Mito 24c |
| 5 | MALSRAVCGTSRQLAPVLGYLGSRQKHSLPDYPYDVPDYAGYPYDVPDY AGYPYDVPDYAMDIADLRTLGYSQQQQEKIKPKVRSTVAQHHEALVGHG FTHAHIVALSQHPAALGTVAVKYQDMIAALPEATHEAIVGVGKQWSGAR ALEALLTVAGELRGPPLQLDTGQLLKIAKRGGVTAVEAVHAWRNALTGA PLNLTPQQVVAIASNNGGKQALETVQRLLPVLCQAHGLTPEQVVAIASN IGGKQALETVQALLPVLCQAHGLTPEQVVAIASHDGGKQALETVQRLLP VLCQAHGLTPEQVVAIASHDGGKQALETVQRLLPVLCQAHGLTPEQVVA IASHDGGKQALETVQRLLPVLCQAHGLTPEQVVAIASHDGGKQALETVQ | Mito 24d |

-continued

| SEQ ID NO. | Sequence | Description |
|---|---|---|
| | RLLPVLCQAHGLTPEQVVAIASHDGGKQALETVQRLLPVLCQAHGLTPE QVVAIASNIGGKQALETVQALLPVLCQAHGLTPQQVVAIASNGGGKQAL ETVQRLLPVLCQAHGLTPQQVVAIASNGGGRPALESIVAQLSRPDPALA ALTNDHLVALACLGGRPALDAVKKGLGGSGSYALGPYQISAPQLPAYNG QTVGTFYYVNDAGGLESKVFSSGGPTPYPNYANAGHVEGQSALEMRDNG ISEGLVFHNNPEGTCGFCVNMTETLLPENAKMTVVPPEGSGGSTNLSDI IEKETGKQLVIQESILMLPEEVEEVIGNKPESDILVHTAYDESTDENVM LLTSDAPEYKPWALVIQDSNGENKIKML | |
| 6 | MASVLTPLLLRGLTGSARRLPVPRAKIHSLDYKDHDGDYKDHDIDYKDD DDKMDIADLRTLGYSQQQQEKIKPKVRSTVAQHHEALVGHGFTHAHIVA LSQHPAALGTVAVKYQDMIAALPEATHEAIVGVGKRGAGARALEALLTV AGELRGPPLQLDTGQLLKIAKRGGVTAVEAVHAWRNALTGAPLNLTPQQ VVAIASNNGGKQALETVQRLLPVLCQAHGLTPEQVVAIASNIGGKQALE TVQALLPVLCQAHGLTPQQVVAIASNGGGKQALETVQRLLPVLCQAHGL TPQQVVAIASNNGGKQALETVQRLLPVLCQAHGLTPQQVVAIASNNGGK QALETVQRLLPVLCQAHGLTPEQVVAIASHDGGKQALETVQRLLPVLCQ AHGLTPQQVVAIASNGGGKQALETVQRLLPVLCQAHGLTPEQVVAIASN IGGKQALETVQALLPVLCQAHGLTPQQVVAIASNGGGKQALETVQRLLP VLCQAHGLTPQQVVAIASNGGGKQALETVQRLLPVLCQAHGLTPQQVVA IASNGGGRPALESIVAQLSRPDPALAALTNDHLVALACLGGRPALDAVK KGLGGSAIPVKRGATGETKVFTGNSNSPKSPTKGGC | Mito 28 |
| 7 | MASVLTPLLLRGLTGSARRLPVPRAKIHSLDYKDHDGDYKDHDIDYKDD DDKTNLSDIIEKETGKQLVIQESILMLPEEVEEVIGNKPESDILVHTAY DESTDENVMLLTSDAPEYKPWALVIQDSNGENKIKMLSGGSGGSGGSTN LSDIIEKETGKQLVIQESILMLPEEVEEVIGNKPESDILVHTAYDESTD ENVMLLTSDAPEYKPWALVIQDSNGENKIKMLSGGSMDIADLRTLGYSQ QQQEKIKPKVRSTVAQHHEALVGHGFTHAHIVALSQHPAALGTVAVKYQ DMIAALPEATHEAIVGVGKRGAGARALEALLTVAGELRGPPLQLDTGQL LKIAKRGGVTAVEAVHAWRNALTGAPLNLTPQQVVAIASNNGGKQALET VQRLLPVLCQAHGLTPEQVVAIASNIGGKQALETVQALLPVLCQAHGLT PQQVVAIASNGGGKQALETVQRLLPVLCQAHGLTPQQVVAIASNNGGKQ ALETVQRLLPVLCQAHGLTPQQVVAIASNNGGKQALETVQRLLPVLCQA HGLTPEQVVAIASHDGGKQALETVQRLLPVLCQAHGLTPQQVVAIASNG GGKQALETVQRLLPVLCQAHGLTPEQVVAIASNIGGKQALETVQALLPV LCQAHGLTPQQVVAIASNGGGKQALETVQRLLPVLCQAHGLTPQQVVAI ASNGGGKQALETVQRLLPVLCQAHGLTPQQVVAIASNGGGRPALESIVA QLSRPDPALAALTNDHLVALACLGGRPALDAVKKGLGGSAIPVKRGATG ETKVFTGNSNSPKSPTKGGC | Mito 28a |
| 8 | MASVLTPLLLRGLTGSARRLPVPRAKIHSLDYKDHDGDYKDHDIDYKDD DDKMDIADLRTLGYSQQQQEKIKPKVRSTVAQHHEALVGHGFTHAHIVA LSQHPAALGTVAVKYQDMIAALPEATHEAIVGVGKRGAGARALEALLTV AGELRGPPLQLDTGQLLKIAKRGGVTAVEAVHAWRNALTGAPLNLTPQQ VVAIASNNGGKQALETVQRLLPVLCQAHGLTPEQVVAIASNIGGKQALE TVQALLPVLCQAHGLTPQQVVAIASNGGGKQALETVQRLLPVLCQAHGL TPQQVVAIASNNGGKQALETVQRLLPVLCQAHGLTPQQVVAIASNNGGK QALETVQRLLPVLCQAHGLTPEQVVAIASHDGGKQALETVQRLLPVLCQ AHGLTPQQVVAIASNGGGKQALETVQRLLPVLCQAHGLTPEQVVAIASN IGGKQALETVQALLPVLCQAHGLTPQQVVAIASNGGGKQALETVQRLLP VLCQAHGLTPQQVVAIASNGGGKQALETVQRLLPVLCQAHGLTPQQVVA IASNGGGRPALESIVAQLSRPDPALAALINDHLVALACLGGRPALDAVK KGLGGSAIPVKRGATGETKVFTGNSNSPKSPTKGGCSGGSTNLSDIIEK ETGKQLVIQESILMLPEEVEEVIGNKPESDILVHTAYDESTDENVMLLT SDAPEYKPWALVIQDSNGENKIKMLSGGSGGSGGSTNLSDIIEKETGKQ LVIQESILMLPEEVEEVIGNKPESDILVHTAYDESTDENVMLLTSDAPE YKPWALVIQDSNGENKIKML | Mito 28b |
| 9 | MASVLTPLLLRGLTGSARRLPVPRAKIHSLDYKDHDGDYKDHDIDYKDD DDKTNLSDIIEKETGKQLVIQESILMLPEEVEEVIGNKPESDILVHTAY DESTDENVMLLISDAPEYKPWALVIQDSNGENKIKMLSGGSMDIADLRT LGYSQQQQEKIKPKVRSTVAQHHEALVGHGFTHAHIVALSQHPAALGTV AVKYQDMIAALPEATHEAIVGVGKRGAGARALEALLTVAGELRGPPLQL DTGQLLKIAKRGGVTAVEAVHAWRNALTGAPLNLTPQQVVAIASNNGGK QALETVQRLLPVLCQAHGLTPEQVVAIASNIGGKQALETVQALLPVLCQ AHGLTPQQVVAIASNGGGKQALETVQRLLPVLCQAHGLTPQQVVAIASN NGGKQALETVQRLLPVLCQAHGLTPQQVVAIASNNGGKQALETVQRLLP VLCQAHGLTPEQVVAIASHDGGKQALETVQRLLPVLCQAHGLTPQQVVA IASNGGGKQALETVQRLLPVLCQAHGLTPEQVVAIASNIGGKQALETVQ ALLPVLCQAHGLTPQQVVAIASNGGGKQALETVQRLLPVLCQAHGLTPQ QVVAIASNGGGKQALETVQRLLPVLCQAHGLTPQQVVAIASNGGGRPAL ESIVAQLSRPDPALAALINDHLVALACLGGRPALDAVKKGLGGSAIPVK RGATGETKVFTGNSNSPKSPTKGGC | Mito 28c |

-continued

| SEQ ID NO. | Sequence | Description |
|---|---|---|
| 10 | MASVLTPLLLRGLTGSARRLPVPRAKIHSLDYKDHDGDYKDHDIDYKDD DDKMDIADLRTLGYSQQQQEKIKPKVRSTVAQHHEALVGHGFTHAHIVA LSQHPAALGTVAVKYQDMIAALPEATHEAIVGVGKRGAGARALEALLTV AGELRGPPLQLDTGQLLKIAKRGGVTAVEAVHAWRNALTGAPLNLTPQQ VVAIASNNGGKQALETVQRLLPVLCQAHGLTPEQVVAIASNIGGKQALE TVQALLPVLCQAHGLTPQQVVAIASNGGGKQALETVQRLLPVLCQAHGL TPQQVVAIASNNGGKQALETVQRLLPVLCQAHGLTPQQVVAIASNNGGK QALETVQRLLPVLCQAHGLTPEQVVAIASHDGGKQALETVQRLLPVLCQ AHGLTPQQVVAIASNGGGKQALETVQRLLPVLCQAHGLTPEQVVAIASN IGGKQALETVQALLPVLCQAHGLTPQQVVAIASNGGGKQALETVQRLLP VLCQAHGLTPQQVVAIASNGGGKQALETVQRLLPVLCQAHGLTPQQVVA IASNGGGRPALESIVAQLSRPDPALAALINDHLVALACLGGRPALDAVK KGLGGSAIPVKRGATGETKVFTGNSNSPKSPTKGGCSGGSTNLSDIIEK ETGKQLVIQESILMLPEEVEEVIGNKPESDILVHTAYDESTDENVMLLT SDAPEYKPWALVIQDSNGENKIKML | Mito 28d |
| 11 | DIADLRTLGYSQQQQEKIKPKVRSTVAQHHEALVGHGFTHAHIVALSQH PAALGTVAVKYQDMIAALPEATHEAIVGVGKQWSGARALEALLTVAGEL RGPPLQLDTGQLLKIAKRGGVTAVEAVHAWRNALTGAPLNLTPQQVVAI ASHDGGKQALETVQRLLPVLCQAHGLTPEQVVAIASNGGGKQALETVQR LLPVLCQAHGLTPQQVVAIASNGGGKQALETVQRLLPVLCQAHGLTPEQ VVAIASNGGGKQALETVQALLPVLCQAHGLTPQQVVAIASNNGGKQALE TVQRLLPVLCQAHGLTPQQVVAIASNNGGKQALETVQRLLPVLCQAHGL TPEQVVAIASNIGGKQALETVQRLLPVLCQAHGLTPQQVVAIASNNGGK QALETVQRLLPVLCQAHGLTPQQVVAIASNGGGKQALETVQRLLPVLCQ AHGLTPEQVVAIASNIGGKQALETVQRLLPVLCQAHGLTPEQVVAIASN NGGKQALETVQRLLPVLCQAHGLTPQQVVAIASNIGGKQALETVQRLLP VLCQAHGLTPQQVVAIASNIGGRPALESIVAQLSRPDPALAALTNDHLV ALACLGGRPALDAVKKGLG | Modified m.13513- Right TALE |
| 12 | DIADLRTLGYSQQQQEKIKPKVRSTVAQHHEALVGHGFTHAHIVALSQH PAALGTVAVKYQDMIAALPEATHEAIVGVGKQWSGARALEALLTVAGEL RGPPLQLDTGQLLKIAKRGGVTAVEAVHAWRNALTGAPLNLTPQQVVAI ASNIGGKQALETVQRLLPVLCQAHGLTPEQVVAIASNGGGKQALETVQR LLPVLCQAHGLTPQQVVAIASNNGGKQALETVQRLLPVLCQAHGLTPEQ VVAIASNNGGKQALETVQALLPVLCQAHGLTPQQVVAIASNNGGKQALE TVQRLLPVLCQAHGLTPQQVVAIASHDGGKQALETVQRLLPVLCQAHGL TPEQVVAIASNGGGKQALETVQRLLPVLCQAHGLTPQQVVAIASNGGGK QALETVQRLLPVLCQAHGLTPQQVVAIASNGGGKQALETVQRLLPVLCQ AHGLTPEQVVAIASNNGGKQALETVQRLLPVLCQAHGLTPEQVVAIASN NGGKQALETVQRLLPVLCQAHGLTPQQVVAIASNGGGRPALESIVAQLS RPDPALAALTNDHLVALACLGGRPALDAVKKGLG | m.8490- Right TALE |
| 13 | MLSRAVCGTSRQLAPVLGYLGSRQKHSLPD | SOD2 MLS |
| 14 | MSVLTPLLLRGLTGSARRLPVPRAKIHSL | COX8a MLS |
| 15 | ACCACGATCGTTATGCTGATCATACCCTAATGATCCCAGCAAGATAATG TCCTGTCTTCTAAGATGTGCATCAAGCCTGGTACATACTGAAAACCCTA TAAGGTCCTGGATAATTTTTGTTTGATTATTCATTGAAGAAACATTTAT TTTCCAATTGTGTGAAGTTTTTGACTGTTAATAAAAGAATCTGTCAACC ATCAAAAAAAAAAAAAAA | SOD2 3'UTR |
| 16 | ACCACGATCGTTATGCTGATCATACCCTAATGATCCCAGCAAGATAATG TCCTGTCTTCTAAGATGTGCATCAAGCCTGGTACATACTGAAAACCCTA TAAGGTCCTGGATAATTTTTGTTTGATTATTCATTGAAGAAACATTTAT TTTCCAATTGTGTGAAGTTTTTGACTGTTAATAAAAGAATCTGTCAACC ATCAAAAAAAAAAAAAAA | ATP5b 3'UTR |

In addition, the mitoTALE and/or mitoZFP may comprising one of the following mitochondrial targeting sequences which help promote mitochondrial localization, or an amino acid or nucleotide sequence having at least 70%, 75%, 80%, 85%, 90%, 95%, or 99% sequence identity with any one of the following sequences:

| | | |
|---|---|---|
| 13 | MLSRAVCGTSRQLAPVLGYLGSRQKHSLPD | SOD2 (mitochondrial superoxide dismutase) MTS |

-continued

| | | |
|---|---|---|
| 14 | MSVLTPLLLRGLIGSARRLPVPRAKIHSL | COX8a (mitochondrial cytochrome C oxidase subunit 8A) MTS |
| 15 | ACCACGATCGTTATGCTGATCATACCCTAATGATCCCAGCAAGATAATGTCCT<br>GTCTTCTAAGATGTGCATCAAGCCTGGTACATACTGAAAACCCTATAAGGTCC<br>TGGATAATTTTTGTTTGATTATTCATTGAAGAAACATTTATTTTCCAATTGTG<br>TGAAGTTTTTGACTGTTAATAAAAGAATCTGTCAACCATCAAAAAAAAAAAAA<br>AA | SOD2 3'UTR |
| 16 | ACCACGATCGTTATGCTGATCATACCCTAATGATCCCAGCAAGATAATGTCCT<br>GTCTTCTAAGATGTGCATCAAGCCTGGTACATACTGAAAACCCTATAAGGTCC<br>TGGATAATTTTTGTTTGATTATTCATTGAAGAAACATTTATTTTCCAATTGTG<br>TGAAGTTTTTGACTGTTAATAAAAGAATCTGTCAACCATCAAAAAAAAAAAAA<br>AA | ATP5b 3'UTR |

In various embodiments, the mtDNA base editors may comprises a mitoZF. A mitoZF may be a ZF protein comprising one or more mitochondrial localization sequences (MLS). A zinc finger is a small, functional, independently folded domain that coordinates one or more zinc ions to stabilize its structure through cysteine and/or histidine residues. Zinc fingers are structurally diverse and exhibit a wide range of functions, from DNA- or RNA-binding to protein-protein interactions and membrane association. There are more than 40 types of zinc fingers annotated in UniProtKB. The most frequent are the C21H2-type, the CCHC-type, the PHD-type and the RING-type. Examples include Accession Nos. Q7Z 142, P55197, Q9P2R3, Q9P2G1, Q9P2S6, Q8IUH5, P19811, Q92793, P36406. 095081, and Q9ULV3, some of which have the following sequences:

Zinc finger protein: Q7Z 142-1:

MPDFTIIQPD RKFDAAAVAG IFVRSSTSSS FPSASSYIAA KKRKNVDNTS TRKPYSYKDR KRKN-TEEIRN IKKKLFMDLG IVRTNCGIDN EKQ-DREKAMK RKVTETIVTT YCELCEQNFS SSKMLLLHRG KVHNTPYIEC HLCMKLFSQT IQFNRHMKTH YGPNAKIYVQ CELCDRQFKD KQSLRTHWDV SHGSGDNQAV LA (SEQ ID NO: 414), or an amino acid having at least 70%, 75%, 80%, 85%, 90%, 95%, or 99% sequence identity therewith, or fragment thereof.

Zinc finger protein: P55197-4 (isoform-4):

MVSSDRPVSL EDEVSHSMKE MIGGCCVCSD ERG-WAENPLV YCDGHGCSVA VHQACYGIVQ VPTGPWFCRK CESQERAARV RCELCPHKDG ALKRTDNGGW AHVVCALYIP EVQFANVSTM EPIV-LQSVPH DRYNKTCYIC DEQGRESKAA TGACMTCNKH GCRQAFHVTC AQFAGLLCEE EGN-GADNVQY CGYCKYHFSK LKKSKRGSNR SYDQSLSDSS SHSQDKHHEK EKKKYKEKDK HKQKHKKQPE PSPALVPSLT VTTEKTYTST SNNSIS-GSLK RLEDTTARFT NANFQEVSAH TSSGKDVSET RGSEGKGKKS SAHSSGQRGR KPGGGRNPGT TVSAASPFPQ GSFSGTPGSV KSSSGSSVQS PQD-FLSFTDS DLRNDSYSHS QQSSATKDVH KGESGSQEGG VNSFSTLIGL PSTSAVTSQP KSFEN-SPGDL GNSSLPTAGY KRAQTSGIEE ETVKEKKRKG NKQSKHGPGR PKGNKNQENV SHLSVSSASP TSSVASAAGS ITSSSLQKSP TLLRNGSLQS LSVGSSPVGS EISMQYRHDG ACITTFSEL LNAIHNGIYN SNDVAVSFPN VVSGSGSSTP VSSSHLPQQS SGHLQQVGAL SPSAVSSAAP AVAT-TQANTL SGSSLSQAPS HMYGNRSNSS MAA-LIAQSEN NQTDQDLGDN SRNLVGRGSS PRGSL-SPRSP VSSLQIRYDQ PGNSSLENLP PVAASIEQLL ERQWSEGQQF LLEQGTPSDI LGMLKSLHQL QVENRRLEEQ IKNLTAKKER LQLLNAQLSV PFPTI-TANPS PSHQIHTFSA QTAPTTDSLN SSKSPHIGNS FLPDNSLPVL NQDLTSSGQS TSSSSALSTP PPAGQSPAQQ GSGVSGVQQV NGVTVGALAS GMQPVTSTIP AVSAVGGIIG ALPGNQLAIN GIVGAL-NGVM QTPVTMSQNP TPLTHTTVPP NATHPMPATL TNSASGLGLL SDQQRQILIH QQQFQQLLNS QQLT-PEQHQA FLYQLMQHHH QQHHQPELQQ LQIPGPTQIP INNLLAGTQA PPLHTATTNP FLTIHGD-NAS QKVARLSDKT GPVAQEKS (SEQ ID NO: 415), or an amino acid having at least 70%, 75%, 80%, 85%, 90%, 95%, or 99% sequence identity therewith, or fragment thereof.

Zinc finger protein: Q9P2R3-1 (isoform 1):

MAEEEVAKLE KHLMLLRQEY VKLQKKLAET EKRCALLAAQ ANKESSSESF ISRLLAIVAD LYEQEQYSDL KIKVGDRHIS AHKFVLAARS DSWSLANLSS TKELDLSDAN PEVTMTMLRW IYT-DELEFRE DDVFLTELMK LANRFQLQLL RERCEKGVMS LVNVRNCIRF YQTAEELNAS TLMNY-CAEII ASHWDDLRKE DFSSMSAQLL YKMIKSKTEY PLHKAIKVER EDVVFLYLIE MDSQLPGKLN EADHNGDLAL DLALSRRLES IATTLVSHKA DVDMVDKSGW SLLHKGIQRG DLFAATFLIK NGAFVNAATL GAQETPLHLV ALYSSKKHSA DVM-SEMAQIA EALLQAGANP NMQDSKGRTP LHVSI-MAGNE YVFSQLLQCK QLDLELKDHE GSTALWLAVQ HITVSSDQSV NPFEDVPVVN GTSFDENSFA ARLIQRGSHT DAPDTATGNC LLQRAAGAGN EAAALFLATN GAHVNHRNKW GETPLHTACR HGLANLTAEL LQQGANPNLQ TEE-ALPLPKE AASLTSLADS VHLQTPLHMA IAYNHPDVVS VILEQKANAL HATNNLQIIP DFSLKDSRDQ TVLGLALWTG MHTIAAQLLG SGAAINDTMS DGQTLLHMAI QRQDSKSALF LLEHQADINV RTQDGETALQ LAIRNQLPLV VDAIC-TRGAD MSVPDEKGNP PLWLALANNL EDIASTLVRH GCDATCWGPG PGGCLQTLLH RAIDENNEPT ACF-LIRSGCD VNSPRQPGAN GEGEEEARDG QTPLH-LAASW GLEETVQCLL EFGANVNAQD AEGRTPIHVA ISSQHGVIIQ LLVSHPDIHL NVRDRQGLTP FACAMTFKNN KSAEAILKRE SGAAEQVDNK GRN-FLHVAVQ NSDIESVLFL ISVHANVNSR VQDASKLTPL

HLAVQAGSEI IVRNLLLAGA KVNELTKHRQ TALH-LAAQQD LPTICSVLLE NGVDFAAVDE NGN-NALHLAV MHGRLNNIRV LLTECTVDAE AFNLRGQSPL HILGQYGKEN AAAIFDLFLE CMPGY-PLDKP DADGSTVLLL AYMKGNANLC RAIVRSGARL GVNNNQGVNI FNYQVATKQL LFRLLDMLSK EPPWCDGSYC YECTARFGVT TRKHHCRHCG RLLCHKCSTK EIPIIKFDLN KPVRVCNICF DVLTLGGVS (SEQ ID NO: 416), or an amino acid having at least 70%, 75%, 80%, 85%, 90%, 95%, or 99% sequence identity therewith, or fragment thereof.

Zinc finger protein: Q9P2G1-1:

MGNTITKFRK ALINGDENLA CQIYENNPQL KES-LDPNTSY GEPYQHNTPL HYAARHGMNK ILGTFL-GRDG NPNKRNVHNE TSMHLLCMGP QIMISEGALH PRLARPTEDD FRRADCLQMI LKWKGAKLDQ GEY-ERAAIDA VDNKKNTPLH YAAASGMKAC VELL-VKHGGD LFAENENKDT PCDCAEKQHH KDLALN-LESQ MVFSRDPEAE EIEAEYAALD KREPYEGLRP QDLRRLKDML IVETADMLQA PLFTAEALLR AHDW-DREKLL EAWMSNPENC CQRSGVQMPT PPPSGY-NAWD TLPSPRTPRT TRSSVTSPDE ISLSPGDLDT SLCDICMCSI SVFEDPVDMP CGHDFCRGCW ESFLNLKIQE GEAHNIFCPA YDCFQLVPVD IIESVV-SKEM DKRYLQFDIK AFVENNPAIK WCPTPGCDRA VRLTKQGSNT SGSDTLSFPL LRAPAVDCGK GHLFCWECLG EAHEPCDCQT WKNWLQKITE MKPEELVGVS EAYEDAANCL WLLTNSKPCA NCK-SPIQKNE GCNHMQCAKC KYDFCWICLE EWKKHSSSTG GYYRCTRYEV IQHVEEQSKE MTVE-AEKKHK RFQELDRFMH YYTRFKNHEH SYQLEQRLLK TAKEKMEQLS RALKETEGGC PDTT-FIEDAV HVLLKTRRIL KCSYPYGFFL EPKSTKKEIF ELMQTDLEMV TEDLAQKVNR PYLRTPRHKI IKAA-CLVQQK RQEFLASVAR GVAPADSPEA PRRSF-AGGTW DWEYLGFASP EEYAEFQYRR RHRQRRRGDV HSLLSNPPDP DEPSESTLDI PEGGSSSRRP GTSVVSSASM SVLHSSSLRD YTPAS-RSENQ DSLQALSSLD EDDPNILLAI QLSLQESGLA LDEETRDFLS NEASLGAIGT SLPSRLDSVP RNTD-SPRAAL SSSELLELGD SLMRLGAEND PFSTDTLSSH PLSEARSDFC PSSSDPDSAG QDPNINDNLL GNI-MAWFHDM NPQSIALIPP ATTEISADSQ LPCIKDGSEG VKDVELVLPE DSMFEDASVS EGRGTQIEEN PLEEN-ILAGE AASQAGDSGN EAANRGDGSD VSSQTPQTSS DWLEQVHLV (SEQ ID NO: 417), or an amino acid having at least 70%, 75%, 80%, 85%, 90%, 95%, or 99% sequence identity therewith, or fragment thereof.

Zinc finger protein: Q8IUH5-1 (isoform 1):

MGNTITKFRK ALINGDENLA CQIYENNPQL KES-LDPNTSY GEPYQHNTPL HYAARHGMNK ILGTFL-GRDG NPNKRNVHNE TSMHLLCMGP QIMISEGALH PRLARPTEDD FRRADCLQMI LKWKGAKLDQ GEY-ERAAIDA VDNKKNTPLH YAAASGMKAC VELL-VKHGGD LFAENENKDT PCDCAEKQHH KDLALN-LESQ MVFSRDPEAE EIEAEYAALD KREPYEGLRP QDLRRLKDML IVETADMLQA PLFTAEALLR AHDW-DREKLL EAWMSNPENC CQRSGVQMPT PPPSGY-NAWD TLPSPRTPRT TRSSVTSPDE ISLSPGDLDT SLCDICMCSI SVFEDPVDMP CGHDFCRGCW ESFLNLKIQE GEAHNIFCPA YDCFQLVPVD IIESVV-SKEM DKRYLQFDIK AFVENNPAIK WCPTPGCDRA VRLTKQGSNT SGSDTLSFPL LRAPAVDCGK GHLFCWECLG EAHEPCDCQT WKNWLQKITE MKPEELVGVS EAYEDAANCL WLLTNSKPCA NCK-SPIQKNE GCNHMQCAKC KYDFCWICLE EWKKHSSSTG GYYRCTRYEV IQHVEEQSKE MTVE-AEKKHK RFQELDRFMH YYTRFKNHEH SYQLEQRLLK TAKEKMEQLS RALKETEGGC PDTT-FIEDAV HVLLKTRRIL KCSYPYGFFL EPKSTKKEIF ELMQTDLEMV TEDLAQKVNR PYLRTPRHKI IKAA-CLVQQK RQEFLASVAR GVAPADSPEA PRRSF-AGGTW DWEYLGFASP EEYAEFQYRR RHRQRRRGDV HSLLSNPPDP DEPSESTLDI PEGGSSSRRP GTSVVSSASM SVLHSSSLRD YTPAS-RSENQ DSLQALSSLD EDDPNILLAI QLSLQESGLA LDEETRDFLS NEASLGAIGT SLPSRLDSVP RNTD-SPRAAL SSSELLELGD SLMRLGAEND PFSTDTLSSH PLSEARSDFC PSSSDPDSAG QDPNINDNLL GNI-MAWFHDM NPQSIALIPP ATTEISADSQ LPCIKDGSEG VKDVELVLPE DSMFEDASVS EGRGTQIEEN PLEEN-ILAGE AASQAGDSGN EAANRGDGSD VSSQTPQTSS DWLEQVHLV (SEQ ID NO: 417), or an amino acid having at least 70%, 75%, 80%, 85%, 90%, 95%, or 99% sequence identity therewith, or fragment thereof.

Zinc finger protein: P36406-1 (isoform alpha):

MATLVVNKLG AGVDSGRQGS RGTAVVKVLE CGVCEDVFSL QGDKVPRLLL CGHTVCHDCL TRLPLHGRAI RCPFDRQVTD LGDSGVWGLK KNFALLELLE RLQNGPIGQY GAAEESIGIS GESIIRCDED EAHLASVYCT VCATHLCSEC SQVTH-STKTL AKHRRVPLAD KPHEKTMCSQ HQVHAIEFVC LEEGCQTSPL MCCVCKEYGK HQGHKHSVLE PEANQIRASI LDMAHCIRTF TEEISDYSRK LVGIVQHIEG GEQIVEDGIG MAHTEHVPGT AENARSCIRA YFYDLHETLC RQEEMALSVV DAHVREKLIW LRQQQEDMTI LLSEVSAACL HCEKTLQQDD CRVVLAKQEI TRLLETLQKQ QQQFTEVADH IQLDASIPVT FTKDNRVHIG PKMEIRVVTL GLDGAGKTTI LFKLKQDEFM QPIP-TIGFNV ETVEYKNLKF TIWDVGGKHK LRPLWKHYYL NTQAVVFVVD SSHRDRISEA HSE-LAKLLTE KELRDALLLI FANKQDVAGA LSVEEITELL SLHKLCCGRS WYIQGCDARS GMGLYEGLDW LSRQLVAAGV LDVA (SEQ ID NO: 418), or an amino acid having at least 70%, 75%, 80%, 85%, 90%, 95%, or 99% sequence identity therewith, or fragment thereof.

Zinc finger protein: Q9ULV3-1 (isoform-1):

MFSQQQQQQL QQQQQQLQQL QQQQLQQQQL QQQQLLQLQQ LLQQSPPQAP LPMAVSRGLP PQQPQQPLLN LQGTNSASLL NGSMLQRALL LQQLQGLDQF AMPPATYDTA GLTMPTATLG NLR-GYGMASP GLAAPSLTPP QLATPNLQQF FPQATRQSLL GPPPVGVPMN PSQFNLSGRN PQKQARTSSS TTPNRKDSSS QTMPVEDKSD PPEG-SEEAAE PRMDTPEDQD LPPCPEDIAK EKRTPAPEPE PCEASELPAK RLRSSEEPTE KEPPGQLQVK AQPQARMTVP KQTQTPDLLP EALEAQVLPR FQPRVLQVQA QVQSQTQPRI PSTDTQVQPK LQKQAQTQTS PEHLVLQQKQ VQPQLQQEAE PQKQVQPQVQ PQAIHSQGPRQ VQLQQEAEPL KQVQPQVQPQ AHSQPPRQVQ LQLQKQVQTQ TYPQVHTQAQ PSVQPQEHPP AQVSVQPPEQ THEQPHTQPQ VSLLAPEQTP VVVHVCGLEM PPDAV-EAGGG MEKTLPEPVG TQVSMEEIQN ESACGLDVGE CENRAREMPG VWGAGGSLKV TILQSSDSRA FSTVPLTPVP RPSDSVSSTP AATSTPSKQA LQFFCYICKA SCSSQQEFQD HMSEPQHQQR LGEIQHMSQA CLLSLLPVPR DVLETEDEEP PPRRWCNTCQ LYYMGDLIQH RRTQDHKIAK QSLRPFCTVC NRYFKTPRKF VEHVKSQGHK DKAKELKSLE KEIAGQDEDH FITVDAVGCF EGDEEEEEDD EDEEEIEVEE ELCKQVRSRD ISREE-WKGSE TYSPNTAYGV DFLVPVMGYI CRICHKFYHS

NSGAQLSHCK SLGHFENLQK YKAAKNPSPT TRPVSRRCAI NARNALTALF TSSGRPPSQP NTQDKTPSKV TARPSQPPLP RRSTRLKT (SEQ ID NO: 419), or an amino acid having at least 70%, 75%, 80%, 85%, 90%, 95%, or 99% sequence identity therewith, or fragment thereof.

The present disclosure may use any known or available zinc finger protein, or variant or functional fragment thereof. In some embodiments, a mitoZF comprises an amino acid sequence selected from any one of the following amino acid sequences, or an amino acid sequence having at least 70%, 75%, 80%, 85%, 90%, 95%, or 99% sequence identity with any one of the following mitoZF sequences:

```
ZF (R8)
                                         (SEQ ID NO: 398)
MAERPFQCDICMRNFSTSGSLSRHIRTHTGEKPFQCDICMRNFSQSGSLT

RHIRTHTGSEKPFQCDICMRNFSRSDALSQHIRTHTGEKPFQCDICMRNF

SRNDNRITHIRTHTGEKPFQCDICMRNFSRSDHLTQHTKIHLR

ZF (5xZnF-4-R8)
                                         (SEQ ID NO: 402)
MAERPFQCDICMRNFSQASNLISHIRTHTGEKPFQCDICMRNFSTSHSLT

EHIRTHTGSEKPFQCDICMRNFSERSHLREHIRTHTGEKPFQCDICMRNF

SQSGNLTEHIRTHTGEKPFQCDICMRNESSKKALTEHTKIHLR

ZF (5xZnF-10-R8)
                                         (SEQ ID NO: 403)
MAERPFQCDICMRNFSQASNLISHIRTHTGEKPFQCDICMRNFSQRANLR

AHIRTHTGSEKPFQCDICMRNFSQASNLISHIRTHTGEKPFQCDICMRNF

STSHSLTEHIRTHTGEKPFQCDICMRNFSERSHLREHTKIHLR

ZF (R13-1)
                                         (SEQ ID NO: 404)
MAERPFQCDICMRNFSRSDNLSTHIRTHTGEKPFQCDICMRNFSDRSDLS

RHIRTHTGEKPFQCDICMRNFSQSGDLTRHIRTHTGSEKPFQCDICMRNF

SRSDSLSAHIRTHTGEKPFQCDICMRNFSQKATRITHTKIHLR

ZF (5xZnF-9-R13)
                                         (SEQ ID NO: 405)
MAERPFQCDICMRNFSQSSSLVRHIRTHTGEKPFQCDICMRNFSRSDNLV

RHIRTHTGSEKPFQCDICMRNFSQAGHLASHIRTHTGEKPFQCDICMRNF

SRKDNLKNHIRTHTGEKPFQCDICMRNFSRKDALRGHTKIHLR

ZF (5xZnF-12-R13)
                                         (SEQ ID NO: 406)
MAERPFQCDICMRNFSRSDHLTTHIRTHTGEKPFQCDICMRNFSQSSSLV

RHIRTHTGSEKPFQCDICMRNFSRSDNLVRHIRTHTGEKPFQCDICMRNF

SQAGHLASHIRTHTGEKPFQCDICMRNFSRKDNLKNHTKIHLR
```

napDNAbp

In various embodiments, the mtDNA base editors or the polypeptides that comprise the mtDNA base editors (e.g., the pDNAbps and DddA) may include a napDNAbp as the pDNAbp component.

In one aspect, the methods and base editor compositions described herein involve a nucleic acid programmable DNA binding protein (napDNAbp). Each napDNAbp is associated with at least one guide nucleic acid (e.g., guide RNA), which localizes the napDNAbp to a DNA sequence that comprises a DNA strand (i.e., a target strand) that is complementary to the guide nucleic acid, or a portion thereof (e.g., the protospacer of a guide RNA). In other words, the guide nucleic-acid "programs" the napDNAbp (e.g., Cas9 or equivalent) to localize and bind to a complementary sequence. In various embodiments, the napDNAbp can be fused to a herein disclosed adenosine deaminase or cytidine deaminase.

Without being bound by theory, the binding mechanism of a napDNAbp—guide RNA complex, in general, includes the step of forming an R-loop whereby the napDNAbp induces the unwinding of a double-strand DNA target, thereby separating the strands in the region bound by the napDNAbp. The guideRNA protospacer then hybridizes to the "target strand." This displaces a "non-target strand" that is complementary to the target strand, which forms the single strand region of the R-loop. In some embodiments, the napDNAbp includes one or more nuclease activities, which then cut the DNA leaving various types of lesions. For example, the napDNAbp may comprises a nuclease activity that cuts the non-target strand at a first location, and/or cuts the target strand at a second location. Depending on the nuclease activity, the target DNA can be cut to form a "double-stranded break" whereby both strands are cut. In other embodiments, the target DNA can be cut at only a single site, i.e., the DNA is "nicked" on one strand. Exemplary napDNAbp with different nuclease activities include "Cas9 nickase" ("nCas9") and a deactivated Cas9 having no nuclease activities ("dead Cas9" or "dCas9").

The below description of various napDNAbps which can be used in connection with the presently disclose base editors is not meant to be limiting in any way. The base editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 variants have a nickase activity. i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats). The base editors described herein may also comprise Cas9 equivalents, including Cas12a/Cpf1 and Cas12b proteins which are the result of convergent evolution. The napDNAbps used herein (e.g., SpCas9, Cas9 variant, or Cas9 equivalents) may also may also contain various modifications that alter/enhance their PAM specificities. Lastly, the application contemplates any Cas9. Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequence or a reference Cas9 equivalent (e.g., Cas12a/Cpf1).

The napDNAbp can be a CRISPR (clustered regularly interspaced short palindromic repeat)-associated nuclease. As outlined above, CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M, et al., Science 337:816-821(2012), the entire contents of which is hereby incorporated by reference.

In some embodiments, the napDNAbp directs cleavage of one or both strands at the location of a target sequence, such as within the target sequence and/or within the complement of the target sequence. In some embodiments, the napDNAbp directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a napDNAbp that is mutated to with respect to a corresponding wild-type enzyme such that the mutated napDNAbp lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A in reference to the canonical SpCas9 sequence, or to equivalent amino acid positions in other Cas9 variants or Cas9 equivalents.

As used herein, the term "Cas protein" refers to a full-length Cas protein obtained from nature, a recombinant Cas protein having a sequences that differs from a naturally occurring Cas protein, or any fragment of a Cas protein that nevertheless retains all or a significant amount of the requisite basic functions needed for the disclosed methods, i.e., (i) possession of nucleic-acid programmable binding of the Cas protein to a target DNA, and (ii) ability to nick the target DNA sequence on one strand. The Cas proteins contemplated herein embrace CRISPR Cas 9 proteins, as well as Cas9 equivalents, variants (e.g., Cas9 nickase (nCas9) or nuclease inactive Cas9 (dCas9)) homologs, orthologs, or paralogs, whether naturally occurring or non-naturally occurring (e.g., engineered or recombinant), and may include a Cas9 equivalent from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector." Science 2016; 353(6299), the contents of which are incorporated herein by reference.

The terms "Cas9" or "Cas9 nuclease" or "Cas9 moiety" or "Cas9 domain" embrace any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. The term Cas9 is not meant to be particularly limiting and may be referred to as a "Cas9 or equivalent." Exemplary Cas9 proteins are further described herein and/or are described in the art and are incorporated herein by reference. The present disclosure is unlimited with regard to the particular Cas9 that is employed in the base editor (PE) of the invention.

As noted herein, Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., *Proc. Natl. Acad. Sci.* U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference).

Examples of Cas9 and Cas9 equivalents are provided as follows; however, these specific examples are not meant to be limiting. The base editor fusions of the present disclosure may use any suitable napDNAbp, including any suitable Cas9 or Cas9 equivalent.

(1) Wild Type SpCaS9

In one embodiment, the base editor constructs described herein may comprise the "canonical SpCas9" nuclease from *S. pyogenes*, which has been widely used as a tool for genome engineering. This Cas9 protein is a large, multi-domain protein containing two distinct nuclease domains. Point mutations can be introduced into Cas9 to abolish one or both nuclease activities, resulting in a nickase Cas9 (nCas9) or dead Cas9 (dCas9), respectively, that still retains its ability to bind DNA in a sgRNA-programmed manner. In principle, when fused to another protein or domain, Cas9 or variant thereof (e.g., nCas9) can target that protein to virtually any DNA sequence simply by co-expression with an appropriate sgRNA. As used herein, the canonical SpCas9 protein refers to the wild type protein from *Streptococcus pyogenes* having the following amino acid sequence:

| Description | Sequence | SEQ ID NO: |
|---|---|---|
| SpCas9<br>*Streptococcus pyogenes* M1<br>SwissProt Accession No. Q99ZW2<br>Wild type | MDKKYSIGLDIGTNSVGWAVITDEYKVPSKKFKVLGNTDRHSIKKNLIGALLEDS<br>GETAEATRLKRTARRRYTRRKNRICYLQEIFSNEMAKVDDSFFHRLEESELVEED<br>KKHERHPIFGNIVDEVAYHEKYPTIYHLRKKLVDSTDKADLRLIYLALAHMIKER<br>GHFLIEGDLNPDNSDVDKLFIQLVQTYNQLFEENPINASGVDAKAILSARLSKSR<br>RLENLIAQLPGEKKNGLFGNLIALSLGLIPNEKSNEDLAEDAKLQLSKDTYDDDL<br>DNLLAQIGDQYADLFLAAKNLSDAILLSDILRVNTEITKAPLSASMIKRYDEHHQ<br>DLTLLKALVRQQLPEKYKEIFFDQSKNGYAGYIDGGASQEEFYKFIKPILEKMDG<br>TEELLVKLNREDLLRKQRTFDNGSIPHQIHLGELHAILRRQEDFYPFLKDNREKI<br>EKILTFRIPYYVGPLARGNSRFAWMTRKSEETITPWNFEEVVDKGASAQSFIERM<br>TNFDKNLPNEKVLPKHSLLYEYFTVYNELTKVKYVTEGMRKPAFLSGEQKKAIVD<br>LLFKTNRKVTVKQLKEDYFKKIECFDSVEISGVEDRFNASLGTYHDLLKIIKDKD | 28 |

-continued

| Description | Sequence | SEQ ID NO: |
|---|---|---|
| | FLDNEENEDILEDIVLILTLFEDREMIEERLKTYAHLFDDKVMKQLKRRRYTGWG<br>RLSRKLINGIRDKQSGKTILDFLKSDGFANRNFMQLIHDDSLTFKEDIQKAQVSG<br>QGDSLHEHIANLAGSPAIKKGILQTVKVVDELVKVMGRHKPENIVIEMARENQTT<br>QKGQKNSRERMKRIEEGIKELGSQILKEHPVENTQLQNEKLYLYYLQNGRDMYVD<br>QELDINRLSDYDVDHIVPQSFLKDDSIDNKVLTRSDKNRGKSDNVPSEEVVKKMK<br>NYWRQLLNAKLITQRKFDNLTKAERGGLSELDKAGFIKRQLVETRQITKHVAQIL<br>DSRMNTKYDENDKLIREVKVITLKSKLVSDFRKDFQFYKVREINNYHHAHDAYLN<br>AVVGTALIKKYPKLESEFVYGDYKVYDVRKMIAKSEQEIGKATAKYFFYSNIMNE<br>FKTEITLANGEIRKRPLIETNGETGEIVWDKGRDFATVRKVLSMPQVNIVKKTEV<br>QTGGFSKESILPKRNSDKLIARKKDWDPKKYGGFDSPTVAYSVLVVAKVEKGKSK<br>KLKSVKELLGITIMERSSFEKNPIDFLEAKGYKEVKKDLIIKLPKYSLFELENGR<br>KRMLASAGELQKGNELALPSKYVNFLYLASHYEKLKGSPEDNEQKQLFVEQHKHY<br>LDEIIEQISEFSKRVILADANLDKVLSAYNKHRDKPIREQAENIIHLFTLINLGA<br>PAAFKYFDTTIDRKRYTSTKEVLDATLIHQSITGLYETRIDLSQLGGD | |
| SpCas9<br>Reverse<br>translation<br>of<br>SwissProt<br>Accession<br>No. Q99ZW2<br>*Streptococcus*<br>*pyogenes* | ATGGATAAAAAATATAGCATTGGCCTGGATATTGGCACCAACAGCGTGGGCTGGG<br>CGGTGATTACCGATGAATATAAAGTGCCGAGCAAAAAATTTAAAGTGCTGGGCAA<br>CACCGATCGCCATAGCATTAAAAAAAACCTGATTGGCGCGCTGCTGTTTGATAGC<br>GGCGAAACCGCGGAAGCGACCCGCCTGAAACGCACCGCGCGCCGCCGCTATACCC<br>GCCGCAAAAACCGCATTTGCTATCTGCAGGAAATTTTTAGCAACGAAATGGCGAA<br>AGTGGATGATAGCTTTTTTCATCGCCTGGAAGAAAGCTTTCTGGTGGAAGAAGAT<br>AAAAAACATGAACGCCATCCGATTTTTGGCAACATTGTGGATGAAGTGGCGTATC<br>ATGAAAAATATCCGACCATTTATCATCTGCGCAAAAAACTGGTGGATAGCACCGA<br>TAAAGCGGATCTGCGCCTGATTTATCTGGCGCTGGCGCATATGATTAAATTTCGC<br>GGCCATTTTCTGATTGAAGGCGATCTGAACCCGGATAACAGCGATGTGGATAAAC<br>TGTTTATTCAGCTGGTGCAGACCTATAACCAGCTGTTTGAAGAAAACCCGATTAA<br>CGCGAGCGGCGTGGATGCGAAAGCGATTCTGAGCGCGCGCCTGAGCAAAAGCCGC<br>CGCCTGGAAAACCTGATTGCGCAGCTGCCGGGCGAAAAAAAAAACGGCCTGTTTG<br>GCAACCTGATTGCGCTGAGCCTGGGCCTGACCCCGAACTTTAAAAGCAACTTTGA<br>TCTGGCGGAAGATGCGAAACTGCAGCTGAGCAAAGATACCTATGATGATGATCTG<br>GATAACCTGCTGGCGCAGATTGGCGATCAGTATGCGGATCTGTTTCTGGCGGCGA<br>AAAACCTGAGCGATGCGATTCTGCTGAGCGATATTCTGCGCGTGAACACCGAAAT<br>TACCAAAGCGCCGCTGAGCGCGAGCATGATTAAACGCTATGATGAACATCATCAG<br>GATCTGACCCTGCTGAAAGCGCTGGTGCGCCAGCAGCTGCCGGAAAAATATAAAG<br>AAATTTTTTTTGATCAGAGCAAAAACGGCTATGCGGGCTATATTGATGGCGGCGC<br>GAGCCAGGAAGAATTTTATAAATTTATTAAACCGATTCTGGAAAAAATGGATGGC<br>ACCGAAGAACTGCTGGTGAAACTGAACCGCGAAGATCTGCTGCGCAAACAGCGCA<br>CCTTTGATAACGGCAGCATTCCGCATCAGATTCATCTGGGCGAACTGCATGCGAT<br>TCTGCGCCGCCAGGAAGATTTTTATCCGTTTCTGAAAGATAACCGCGAAAAAATT<br>GAAAAAATTCTGACCTTTCGCATTCCGTATTATGTGGGCCCGCTGGCGCGCGGCA<br>ACAGCCGCTTTGCGTGGATGACCCGCAAAAGCGAAGAAACCATTACCCCGTGGAA<br>CTTTGAAGAAGTGGTGGATAAAGGCGCGAGCGCGCAGAGCTTTATTGAACGCATG<br>ACCAACTTTGATAAAAACCTGCCGAACGAAAAAGTGCTGCCGAAACATAGCCTGC<br>TGTATGAATATTTTACCGTGTATAACGAACTGACCAAAGTGAAATATGTGACCGA<br>AGGCATGCGCAAACCGGCGTTTCTGAGCGGCGAACAGAAAAAAGCGATTGTGGAT<br>CTGCTGTTTAAAACCAACCGCAAAGTGACCGTGAAACAGCTGAAAGAAGATTATT<br>TTAAAAAAATTGAATGCTTTGATAGCGTGGAAATTAGCGGCGTGGAAGATCGCTT<br>TAACGCGAGCCTGGGCACCTATCATGATCTGCTGAAAATTATTAAAGATAAAGAT<br>TTTCTGGATAACGAAGAAAACGAAGATATTCTGGAAGATATTGTGCTGACCCTGA<br>CCCTGITTGAAGATCGCGAAATGATTGAAGAACGCCTGAAAACCTATGCGCATCT<br>GTTTGATGATAAAGTGATGAAACAGCTGAAACGCCGCCGCTATACCGGCTGGGGC<br>CGCCTGAGCCGCAAACTGATTAACGGCATTCGCGATAAACAGAGCGGCAAAACCA<br>TTCTGGATTTTCTGAAAAGCGATGGCTTTGCGAACCGCAACTTTATGCAGCTGAT<br>TCATGATGATAGCCTGACCTTTAAAGAAGATATTCAGAAAGCGCAGGTGAGCGGC<br>CAGGGCGATAGCCTGCATGAACATATTGCGAACCTGGCGGGCAGCCCGGCGATTA<br>AAAAAGGCATTCTGCAGACCGTGAAAGTGGTGGATGAACTGGTGAAAGTGATGGG<br>CCGCCATAAACCGGAAAACATTGTGATTGAAATGGCGCGCGAAAACCAGACCACC<br>CAGAAAGGCCAGAAAAACAGCCGCGAACGCATGAAACGCATTGAAGAAGGCATTA<br>AAGAACTGGGCAGCCAGATTCTGAAAGAACATCCGGTGGAAAACACCCAGCTGCA<br>GAACGAAAAACTGTATCTGTATTATCTGCAGAACGGCCGCGATATGTATGTGGAT<br>CAGGAACTGGATATTAACCGCCTGAGCGATTATGATGTGGATCATATTGTGCCGC<br>AGAGCTTTCTGAAAGATGATAGCATTGATAACAAAGTGCTGACCCGCAGCGATAA<br>AAACCGCGGCAAAAGCGATAACGTGCCGAGCGAAGAAGTGGTGAAAAAAATGAAA<br>AACTATTGGCGCCAGCTGCTGAACGCGAAACTGATTACCCAGCGCAAATTTGATA<br>ACCTGACCAAAGCGGAACGCGGCGGCCTGAGCGAACTGGATAAAGCGGGCTTTAT<br>TAAACGCCAGCTGGTGGAAACCCGCCAGATTACCAAACATGTGGCGCAGATTCTG<br>GATAGCCGCATGAACACCAAATATGATGAAAACGATAAACTGATTCGCGAAGTGA<br>AAGTGATTACCCTGAAAAGCAAACTGGTGAGCGATTTTCGCAAAGATTTTCAGIT<br>TTATAAAGTGCGCGAAATTAACAACTATCATCATGCGCATGATGCGTATCTGAAC<br>GCGGTGGTGGGCACCGCGCTGATTAAAAAATATCCGAAACTGGAAAGCGAATTTG<br>TGTATGGCGATTATAAAGTGTATGATGTGCGCAAAATGATTGCGAAAAGCGAACA<br>GGAAATTGGCAAAGCGACCGCGAAATATTTTTTTTATAGCAACATTATGAACTTT<br>TTTAAAACCGAAATTACCCTGGCGAACGGCGAAATTCGCAAACGCCCGCTGATTG<br>AAACCAACGGCGAAACCGGCGAAATTGTGTGGGATAAAGGCCGCGATTTTGCGAC<br>CGTGCGCAAAGTGCTGAGCATGCCGCAGGTGAACATTGTGAAAAAAACCGAAGTG<br>CAGACCGGCGGCTTTAGCAAAGAAAGCATTCTGCCGAAACGCAACAGCGATAAAC<br>TGATTGCGCGCAAAAAAGATTGGGATCCGAAAAAATATGGCGGCTTTGATAGCCC | 29 |

-continued

| Description | Sequence | SEQ ID NO: |
|---|---|---|
| | GACCGTGGCGTATAGCGTGCTGGTGGTGGCGAAAGTGGAAAAAGGCAAAAGCAAA<br>AAACTGAAAAGCGTGAAAGAACTGCTGGGCATTACCATTATGGAACGCAGCAGCT<br>TTGAAAAAAACCCGATTGATTTTCTGGAAGCGAAAGGCTATAAAGAAGTGAAAAA<br>AGATCTGATTATTAAACTGCCGAAATATAGCCTGTTTGAACTGGAAAACGGCCGC<br>AAACGCATGCTGGCGAGCGCGGGCGAACTGCAGAAAGGCAACGAACTGGCGCTGC<br>CGAGCAAATATGTGAACTTTCTGTATCTGGCGAGCCATTATGAAAAACTGAAAGG<br>CAGCCCGGAAGATAACGAACAGAAACAGCTGTTTGTGGAACAGCATAAACATTAT<br>CTGGATGAAATTATTGAACAGATTAGCGAATTTAGCAAACGCGTGATTCTGGCGG<br>ATGCGAACCTGGATAAAGTGCTGAGCGCGTATAACAAACATCGCGATAAACCGAT<br>TCGCGAACAGGCGGAAAACATTATTCATCTGTTTACCCTGACCAACCTGGGCGCG<br>CCGGCGGCGTTTAAATATTTTGATACCACCATTGATCGCAAACGCTATACCAGCA<br>CCAAAGAAGTGCTGGATGCGACCCTGATTCATCAGAGCATTACCGGCCTGTATGA<br>AACCCGCATTGATCTGAGCCAGCTGGGCGGCGAT | |

The base editors described herein may include canonical SpCas9, or any variant thereof having at least 80%, at least 85%, at least 90%, at least 95%, or at least 99% sequence identity with a wild type Cas9 sequence provided above. These variants may include SpCas9 variants containing one or more mutations, including any known mutation reported with the SwissProt Accession No. Q99ZW2 entry, which include:

| SpCas9 mutation (relative to the amino acid sequence of the canonical SpCas9 sequence, SEQ ID NO: 28) | Function/Characteristic (as reported) (see UniProtKB - Q99ZW2 (CAS9_STRPT1) entry - incorporated herein by reference) |
|---|---|
| D10A | Nickase mutant which cleaves the protospacer strand (but no cleavage of non-protospacer strand) |
| S15A | Decreased DNA cleavage activity |
| R66A | Decreased DNA cleavage activity |
| R70A | No DNA cleavage |
| R74A | Decreased DNA cleavage |
| R78A | Decreased DNA cleavage |

-continued

| SpCas9 mutation (relative to the amino acid sequence of the canonical SpCas9 sequence, SEQ ID NO: 28) | Function/Characteristic (as reported) (see UniProtKB - Q99ZW2 (CAS9_STRPT1) entry - incorporated herein by reference) |
|---|---|
| 97-150 deletion | No nuclease activity |
| R165A | Decreased DNA cleavage |
| 175-307 deletion | About 50% decreased DNA cleavage |
| 312-409 deletion | No nuclease activity |
| E762A | Nickase |
| H840A | Nickase mutant which cleaves the non-protospacer strand but does not cleave the protospacer strand |
| N854A | Nickase |
| N863A | Nickase |
| H982A | Decreased DNA cleavage |
| D986A | Nickase |
| 1099-1368 deletion | No nuclease activity |
| R1333A | Reduced DNA binding |

Other wild type SpCas9 sequences that may be used in the present disclosure, include:

| Description | Sequence | SEQ ID NO: |
|---|---|---|
| SpCas9<br>*Streptococcus pyogenes*<br>MGAS1882<br>wild type<br>NC_017053.1 | ATGGATAAGAAATACTCAATAGGCTTAGATATCGGCACAAATAGCGTCGGATGGGCGGT<br>GATCACTGATGATTATAAGGTTCCGTCTAAAAAGTTCAAGGTTCTGGGAAATACAGACC<br>GCCACAGTATCAAAAAAAATCTTATAGGGGCTCTTTTATTTGGCAGTGGAGAGACAGCG<br>GAAGCGACTCGTCTCAAACGGACAGCTCGTAGAAGGTATACACGTCGGAAGAATCGTAT<br>TTGTTATCTACAGGAGATTTTTTCAAATGAGATGGCGAAAGTAGATGATAGTTTCTTTC<br>ATCGACTTGAAGAGTCTTTTTTGGTGGAAGAAGACAAGAAGCATGAACGTCATCCTATT<br>TTTGGAAATATAGTAGATGAAGTTGCTTATCATGAGAAATATCCAACTATCTATCATCT<br>GCGAAAAAAATTGGCAGATTCTACTGATAAAGCGGATTTGCGCTTAATCTATTTGGCCT<br>TAGCGCATATGATTAAGTTTCGTGGTCATTTTTTGATTGAGGGAGATTTAAATCCTGAT<br>AATAGTGATGTGGACAAACTATTTATCCAGTTGGTACAAATCTACAATCAATTATTTGA<br>AGAAAACCCTATTAACGCAAGTAGAGTAGATGCTAAAGCGATTCTTTCTGCACGATTGA<br>GTAAATCAAGACGATTAGAAAATCTCATTGCTCAGCTCCCCGGTGAGAAGAGAAATGGC<br>TTGTTTGGGAATCTCATTGCTTTGTCATTGGGATTGACCCCTAATTTTAAATCAAATTT<br>TGATTTGGCAGAAGATGCTAAATTACAGCTTTCAAAAGATACTTACGATGATGATTTAG<br>ATAATTTATTGGCGCAAATTGGAGATCAATATGCTGATTTGTTTTTGGCAGCTAAGAAT<br>TTATCAGATGCTATTTTACTTTCAGATATCCTAAGAGTAAATAGTGAAATAACTAAGGC<br>TCCCCTATCAGCTTCAATGATTAAGCGCTACGATGAACATCATCAAGACTTGACTCTTT<br>TAAAAGCTTTAGTTCGACAACAACTTCCAGAAAAGTATAAAGAAATCTTTTTTGATCAA<br>TCAAAAAACGGATATGCAGGTTATATTGATGGGGGAGCTAGCCAAGAAGAATTTTATAA<br>ATTTATCAAACCAATTTTAGAAAAAATGGATGGTACTGAGGAATTATTGGTGAAACTAA<br>ATCGTGAAGATTTGCTGCGCAAGCAACGGACCTTTGACAACGGCTCTATTCCCCATCAA<br>ATTCACTTGGGTGAGCTGCATGCTATTTTGAGAAGACAAGAAGACTTTTATCCATTTTT<br>AAAAGACAATCGTGAGAAGATTGAAAAAATCTTGACTTTTCGAATTCCTTATTATGTTG<br>GTCCATTGGCGCGTGGCAATAGTCGTTTTGCATGGATGACTCGGAAGTCTGAAGAAACA<br>ATTACCCCATGGAATTTTGAAGAAGTTGTCGATAAAGGTGCTTCAGCTCAATCATTTAT<br>TGAACGCATGACAAACTTTGATAAAAATCTTCCAAATGAAAAAGTACTACCAAAACATA<br>GTTTGCTTTATGAGTATTTTACGGITTATAACGAATTGACAAAGGTCAAATATGTTACT<br>GAGGGAATGCGAAAACCAGCATTTCTTTCAGGTGAACAGAAGAAAGCCATTGTTGATTT<br>ACTCTTCAAAACAAATCGAAAAGTAACCGTTAAGCAATTAAAAGAAGATTATTTCAAAA<br>AAATAGAATGTTTTGATAGTGTTGAAATTTCAGGAGTTGAAGATAGATTTAATGCTTCA<br>TTAGGCGCCTACCATGATTTGCTAAAAATTATTAAAGATAAAGATTTTTTGGATAATGA | 30 |

-continued

| Description | Sequence | SEQ ID NO: |
|---|---|---|
| | AGAAAATGAAGATATCTTAGAGGATATTGTTTTAACATTGACCTTATTTGAAGATAGGG GGATGATTGAGGAAAGACTTAAAACATATGCTCACCTCTTTGATGATAAGGTGATGAAA CAGCTTAAACGTCGCCGTTATACTGGTTGGGGACGTTTGTCTCGAAAATTGATTAATGG TATTAGGGATAAGCAATCTGGCAAAACAATATTAGATTTTTTGAAATCAGATGGTTTTG CCAATCGCAATTTTATGCAGCTGATCCATGATGATAGTTTGACATTTAAAGAAGATATT CAAAAAGCACAGGTGTCTGGACAAGGCCATAGTTTACATGAACAGATTGCTAACTTAGC TGGCAGTCCTGCTATTAAAAAAGGTATTTTACAGACTGTAAAAATTGTTGATGAACTGG TCAAAGTAATGGGGCATAAGCCAGAAAATATCGTTATTGAAATGGCACGTGAAAATCAG ACAACTCAAAAGGGCCAGAAAAATTCGCGAGAGCGTATGAAACGAATCGAAGAAGGTAT CAAAGAATTAGGAAGTCAGATTCTTAAAGAGCATCCTGTTGAAAATACTCAATTGCAAA ATGAAAAGCTCTATCTCTATTATCTACAAAATGGAAGAGACATGTATGTGGACCAAGAA TTAGATATTAATCGTTTAAGTGATTATGATGTCGATCACATTGTTCCACAAAGTTTCAT TAAAGACGATTCAATAGACAATAAGGTACTAACGCGTTCTGATAAAAATCGTGGTAAAT CGGATAACGTTCCAAGTGAAGAAGTAGTCAAAAAGATGAAAAACTATTGGAGACAACTT CTAAACGCCAAGTTAATCACTCAACGTAAGTTTGATAATTTAACGAAAGCTGAACGTGG AGGTTTGAGTGAACTTGATAAAGCTGGTTTTATCAAACGCCAATTGGTTGAAACTCGCC AAATCACTAAGCATGTGGCACAAATTTTGGATAGTCGCATGAATACTAAATACGATGAA AATGATAAACTTATTCGAGAGGTTAAAGTGATTACCTTAAAATCTAAATTAGTTTCTGA CTTCCGAAAAGATTTCCAATTCTATAAAGTACGTGAGATTAACAATTACCATCATGCCC ATGATGCGTATCTAAATGCCGTCGTTGGAACTGCTTTGATTAAGAAATATCCAAAACTT GAATCGGAGTTTGTCTATGGTGATTATAAAGTTTATGATGTTCGTAAAATGATTGCTAA GTCTGAGCAAGAAATAGGCAAAGCAACCGCAAAATATTTCTTTTACTCTAATATCATGA ACTTCTTCAAAACAGAAATTACACTTGCAAATGGAGAGATTCGCAAACGCCCTCTAATC GAAACTAATGGGGAAACTGGAGAAATTGTCTGGGATAAAGGGCGAGATTTTGCCACAGT GCGCAAAGTATTGTCCATGCCCCAAGTCAATATTGTCAAGAAAACAGAAGTACAGACAG GCGGATTCTCCAAGGAGTCAATTTTACCAAAAAGAAATTCGGACAAGCTTATTGCTCGT AAAAAAGACTGGGATCCAAAAAAATATGGTGGTTTTGATAGTCCAACGGTAGCTTATTC AGTCCTAGTGGTTGCTAAGGTGGAAAAAGGGAAATCGAAGAAGTTAAAATCCGTTAAAG AGTTACTAGGGATCACAATTATGGAAAGAAGTTCCTTTGAAAAAAATCCGATTGACTTT TTAGAAGCTAAAGGATATAAGGAAGTTAAAAAAGACTTAATCATTAAACTACCTAAATA TAGTCTTTTTGAGTTAGAAAACGGTCGTAAACGGATGCTGGCTAGTGCCGGAGAATTAC AAAAAGGAAATGAGCTGGCTCTGCCAAGCAAATATGTGAATTTTTTATATTTAGCTAGT CATTATGAAAAGTTGAAGGGTAGTCCAGAAGATAACGAACAAAAACAATTGTTTGTGGA GCAGCATAAGCATTATTTAGATGAGATTATTGAGCAAATCAGTGAATTTTCTAAGCGTG TTATTTTAGCAGATGCCAATTTAGATAAAGTTCTTAGTGCATATAACAAACATAGAGAC AAACCAATACGTGAACAAGCAGAAAATATTATTCATTTATTTACGTTGACGAATCTTGG AGCTCCCGCTGCTTTTAAATATTTTGATACAACAATTGATCGTAAACGATATACGTCTA CAAAAGAAGTTTTAGATGCCACTCTTATCCATCAATCCATCACTGGTCTTTATGAAACA CGCATTGATTTGAGTCAGCTAGGAGGTGACTGA | |
| SpCas9 *Streptococcus pyogenes* MGAS1882 wild type NC_017053.1 | MDKKYSIGLDIGTNSVGWAVITDDYKVPSKKFKVLGNTDRHSIKKNLIGALLFGSGETA EATRLKRTARRRYTRRKNRICYLQEIFSNEMAKVDDSFFHRLEESELVEEDKKHERHPI FGNIVDEVAYHEKYPTIYHLRKKLADSTDKADLRLIYLALAHMIKERGHFLIEGDLNPD NSDVDKLFIQLVQIYNQLFEENPINASRVDAKAILSARLSKSRRLENLIAQLPGEKRNG LFGNLIALSLGLTPNFKSNFDLAEDAKLILSKDTYDDDLDNLLAQIGDQYADLFLAAKN LSDAILLSDILRVNSEITKAPLSASMIKRYDEHHQDLILLKALVRIILPEKYKEIFFDQ SKNGYAGYIDGGASQEEFYKFIKPILEKMDGTEELLVKLNREDLLRKIRTEDNGSIPHQ IHLGELHAILRRQEDFYPFLKDNREKIEKILTFRIPYYVGPLARGNSRFAWMTRKSEET ITPWNFEEVVDKGASAQSFIERMTNFDKNLPNEKVLPKHSLLYEYFTVYNELTKVKYVT EGMRKPAFLSGEQKKAIVDLLFKTNRKVTVKILKEDYFKKIECFDSVEISGVEDRENAS LGAYHDLLKIIKDKDELDNEENEDILEDIVLTLTLFEDRGMIEERLKTYAHLEDDKVMK QLKRRRYTGWGRLSRKLINGIRDKQSGKTILDFLKSDGFANRNFMQLIHDDSLTFKEDI QKAQVSGQGHSLHEQIANLAGSPAIKKGILQTVKIVDELVKVMGHKPENIVIEMARENQ TTQKGQKNSRERMKRIEEGIKELGSQILKEHPVENTQLQNEKLYLYYLINGRDMYVDQE LDINRLSDYDVDHIVPQSFIKDDSIDNKVLTRSDKNRGKSDNVPSEEVVKKMKNYWRQL LNAKLITQRKFDNLTKAERGGLSELDKAGFIKRQLVETRIITKHVAQILDSRMNTKYDE NDKLIREVKVITLKSKLVSDFRKDFQFYKVREINNYHHAHDAYLNAVVGTALIKKYPKL ESEFVYGDYKVYDVRKMIAKSEQEIGKATAKYFFYSNIMNFFKTEITLANGEIRKRPLI ETNGETGEIVWDKGRDFATVRKVLSMPQVNIVKKTEVQTGGFSKESILPKRNSDKLIAR KKDWDPKKYGGFDSPTVAYSVLVVAKVEKGKSKKLKSVKELLGITIMERSSFEKNPIDF LEAKGYKEVKKDLIIKLPKYSLFELENGRKRMLASAGELQKGNELALPSKYVNFLYLAS HYEKLKGSPEDNEQKILFVEQHKHYLDEIIEQISEFSKRVILADANLDKVLSAYNKHRD KPIREQAENIIHLFTLTNLGAPAAFKYFDTTIDRKRYTSTKEVLDATLIHQSITGLYET RIDLSQLGGD | 31 |
| SpCas9 *Streptococcus pyogenes* wild type SWBC2D7W014 | ATGGATAAAAAGTATTCTATTGGTTTAGACATCGGCACTAATTCCGTTGGATGGGCTGT CATAACCGATGAATACAAAGTACCTTCAAAGAAATTTAAGGTGTTGGGGAACACAGACC GTCATTCGATTAAAAAGAATCTTATCGGTGCCCTCCTATTCGATAGTGGCGAAACGGCA GAGGCGACTCGCCTGAAACGAACCGCTCGGAGAAGGTATACACGTCGCAAGAACCGAAT ATGTTACTTACAAGAAATTTTTAGCAATGAGATGGCCAAAGTTGACGATTCTTTCTTTC ACCGTTTGGAAGAGTCCTTCCTTGTCGAAGAGGACAAGAAACATGAACGGCACCCCATC TTTGGAAACATAGTAGATGAGGTGGCATATCATGAAAAGTACCCAACGATTTATCACCT CAGAAAAAAGCTAGTTGACTCAACTGATAAAGCGGACCTGAGGTTAATCTACTTGGCTC TTGCCCATATGATAAAGTTCCGTGGGCACTTTCTCATTGAGGGTGATCTAAATCCGGAC AACTCGGATGTCGACAAACTGTTCATCCAGTTAGTACAAACCTATAATCAGTTGTTTGA AGAGAACCCTATAAATGCAAGTGGCGTGGATGCGAAGGCTATTCTTAGCGCCCGCCTCT CTAAATCCCGACGGCTAGAAAACCTGATCGCACAATTACCCGGAGAGAAGAAAAATGGG | 32 |

-continued

| Description | Sequence | SEQ ID NO: |
|---|---|---|
| | TTGTTCGGTAACCTTATAGCGCTCTCACTAGGCCTGACACCAAATTTTAAGTCGAACTT CGACTTAGCTGAAGATGCCAAATTGCAGCTTAGTAAGGACACGTACGATGACGATCTCG ACAATCTACTGGCACAAATTGGAGATCAGTATGCGGACTTATTTTTGGCTGCCAAAAAC CTTAGCGATGCAATCCTCCTATCTGACATACTGAGAGTTAATACTGAGATTACCAAGGC GCCGTTATCCGCTTCAATGATCAAAAGGTACGATGAACATCACCAAGACTTGACACTTC TCAAGGCCCTAGTCCGTCAGCAACTGCCTGAGAAATATAAGGAAATATTCTTTGATCAG TCGAAAAACGGGTACGCAGGTTATATTGACGGCGGAGCGAGTCAAGAGGAATTCTACAA GTTTATCAAACCCATATTAGAGAAGATGGATGGGACGGAAGAGTTGCTTGTAAAACTCA ATCGCGAAGATCTACTGCGAAAGCAGCGGACTTTCGACAACGGTAGCATTCCACATCAA ATCCACTTAGGCGAATTGCATGCTATACTTAGAAGGCAGGAGGATTTTTATCCGTTCCT CAAAGACAATCGTGAAAAGATTGAGAAAATCCTAACCTTTCGCATACCTTACTATGTGG GACCCCTGGCCCGAGGGAACTCTCGGTTCGCATGGATGACAAGAAAGTCCGAAGAAACG ATTACTCCATGGAATTTTGAGGAAGTTGTCGATAAAGGTGCGTCAGCTCAATCGTTCAT CGAGAGGATGACCAACTTTGACAAGAATTTACCGAACGAAAAAGTATTGCCTAAGCACA GTTTACTTTACGAGTATTTCACAGTGTACAATGAACTCACGAAAGTTAAGTATGTCACT GAGGGCATGCGTAAACCCGCCTTTCTAAGCGGAGAACAGAAGAAAGCAATAGTAGATCT GTTATTCAAGACCAACCGCAAAGTGACAGTTAAGCAATTGAAAGAGGACTACTTTAAGA AAATTGAATGCTTCGATTCTGTCGAGATCTCCGGGGTAGAAGATCGATTTAATGCGTCA CTTGGTACGTATCATGACCTCCTAAAGATAATTAAAGATAAGGACTTCCTGGATAACGA AGAGAATGAAGATATCTTAGAAGATATAGTGTTGACTCTTACCCTCTTTGAAGATCGGG AAATGATTGAGGAAAGACTAAAAACATACGCTCACCTGTTCGACGATAAGGTTATGAAA CAGTTAAAGAGGCGTCGCTATACGGGCTGGGGACGATTGTCGCGGAAACTTATCAACGG GATAAGAGACAAGCAAAGTGGTAAAACTATTCTCGATTTTCTAAAGAGCGACGGCTTCG CCAATAGGAACTTTATGCAGCTGATCCATGATGACTCTTTAACCTTCAAAGAGGATATA CAAAAGGCACAGGTTTCCGGACAAGGGGACTCATTGCACGAACATATTGCGAATCTTGC TGGTTCGCCAGCCATCAAAAAGGGCATACTCCAGACAGTCAAAGTAGTGGATGAGCTAG TTAAGGTCATGGGACGTCACAAACCGGAAAACATTGTAATCGAGATGGCACGCGAAAAT CAAACGACTCAGAAGGGGCAAAAAAACAGTCGAGAGCGGATGAAGAGAATAGAAGAGGG TATTAAAGAACTGGGCAGCCAGATCTTAAAGGAGCATCCTGTGGAAAATACCCAATTGC AGAACGAGAAACTTTACCTCTATTACCTACAAAATGGAAGGGACATGTATGTTGATCAG GAACTGGACATAAACCGTTTATCTGATTACGACGTCGATCACATTGTACCCCAATCCTT TTTGAAGGACGATTCAATCGACAATAAAGTGCTTACACGCTCGGATAAGAACCGAGGGA AAAGTGACAATGTTCCAAGCGAGGAAGTCGTAAAGAAAATGAAGAACTATTGGCGGCAG CTCCTAAATGCGAAACTGATAACGCAAAGAAAGTTCGATAACTTAACTAAAGCTGAGAG GGGTGGCTTGTCTGAACTTGACAAGGCCGGATTTATTAAACGTCAGCTCGTGGAAACCC GCCAAATCACAAAGCATGTTGCACAGATACTAGATTCCCGAATGAATACGAAATACGAC GAGAACGATAAGCTGATTCGGGAAGTCAAAGTAATCACTTTAAAGTCAAAATTGGTGTC GGACTTCAGAAAGGATTTTCAATTCTATAAAGTTAGGGAGATAAATAACTACCACCATG CGCACGACGCTTATCTTAATGCCGTCGTAGGGACCGCACTCATTAAGAAATACCCGAAG CTAGAAAGTGAGTTTGTGTATGGTGATTACAAAGTTTATGACGTCCGTAAGATGATCGC GAAAAGCGAACAGGAGATAGGCAAGGCTACAGCCAAATACTTCTTTTATTCTAACATTA TGAATTTCTTTAAGACGGAAATCACTCTGGCAAACGGAGAGATACGCAAACGACCTTTA ATTGAAACCAATGGGGAGACAGGTGAAATCGTATGGGATAAGGGCCGGGACTTCGCGAC GGTGAGAAAAGTTTTGTCCATGCCCCAAGTCAACATAGTAAAGAAAACTGAGGTGCAGA CCGGAGGGTTTTCAAAGGAATCGATTCTTCCAAAAAGGAATAGTGATAAGCTCATCGCT CGTAAAAAGGACTGGGACCCGAAAAAGTACGGTGGCTTCGATAGCCCTACAGTTGCCTA TTCTGTCCTAGTAGTGGCAAAAGTTGAGAAGGGAAAATCCAAGAAACTGAAGTCAGTCA AAGAATTATTGGGGATAACGATTATGGAGCGCTCGTCTTTTGAAAAGAACCCCATCGAC TTCCTTGAGGCGAAAGGTTACAAGGAAGTAAAAAAGGATCTCATAATTAAACTACCAAA GTATAGTCTGTTTGAGTTAGAAAATGGCCGAAAACGGATGTTGGCTAGCGCCGGAGAGC TTCAAAAGGGGAACGAACTCGCACTACCGTCTAAATACGTGAATTTCCTGTATTTAGCG TCCCATTACGAGAAGTTGAAAGGTTCACCTGAAGATAACGAACAGAAGCAACTTTTTGT TGAGCAGCACAAACATTATCTCGACGAAATCATAGAGCAAATTTCGGAATTCAGTAAGA GAGTCATCCTAGCTGATGCCAATCTGGACAAAGTATTAAGCGCATACAACAAGCACAGG GATAAACCCATACGTGAGCAGGCGGAAAATATTATCCATTTGTTTACTCTTACCAACCT CGGCGCTCCAGCCGCATTCAAGTATTTTGACACAACGATAGATCGCAAACGATACACTT CTACCAAGGAGGTGCTAGACGCGACACTGATTCACCAATCCATCACGGGATTATATGAA ACTCGGATAGATTTGTCACAGCTTGGGGGTGACGGATCCCCCAAGAAGAAGAGGAAAGT CTCGAGCGACTACAAAGACCATGACGGTGATTATAAAGATCATGACATCGATTACAAGG ATGACGATGACAAGGCTGCAGGA | |
| SpCas9 *Streptococcus pyogenes* wild type Encoded product of SWBC2D7W014 | MDKKYSIGLDIGTNSVGWAVITDEYKVPSKKFKVLGNTDRHSIKKNLIGALLFDSGETA EATRLKRTARRRYTRRKNRICYLQEIFSNEMAKVDDSFFHRLEESELVEEDKKHERHPI FGNIVDEVAYHEKYPTIYHLRKKLVDSTDKADLRLIYLALAHMIKFRGHFLIEGDLNPD NSDVDKLFIQLVQTYNQLFEENPINASGVDAKAILSARLSKSRRLENLIAILPGEKKNG LFGNLIALSLGLIPNFKSNEDLAEDAKLILSKDTYDDDLDNLLAQIGDQYADLFLAAKN LSDAILLSDILRVNTEITKAPLSASMIKRYDEHHQDLILLKALVRQQLPEKYKEIFFDQ SKNGYAGYIDGGASQEEFYKFIKPILEKMDGTEELLVKLNREDLLRKIRTEDNGSIPHQ IHLGELHAILRRQEDFYPFLKDNREKIEKILTFRIPYYVGPLARGNSRFAWMTRKSEET ITPWNFEEVVDKGASAQSFIERMTNFDKNLPNEKVLPKHSLLYEYFTVYNELTKVKYVT EGMRKPAFLSGEQKKAIVDLLFKTNRKVTVKILKEDYFKKIECFDSVEISGVEDRENAS LGTYHDLLKIIKDKDELDNEENEDILEDIVLILTLFEDREMIEERLKTYAHLEDDKVMK QLKRRRYTGWGRLSRKLINGIRDKQSGKTILDFLKSDGFANRNFMQLIHDDSLTFKEDI QKAQVSGQGDSLHEHIANLAGSPAIKKGILQTVKVVDELVKVMGRHKPENIVIEMAREN QTTQKGQKNSRERMKRIEEGIKELGSQILKEHPVENTQLQNEKLYLYYLINGRDMYVDQ ELDINRLSDYDVDHIVPQSFLKDDSIDNKVLTRSDKNRGKSDNVPSEEVVKKMKNYWRQ LLNAKLITIRKFDNLTKAERGGLSELDKAGFIKRQLVETRQITKHVAQILDSRMNTKYD | 33 |

-continued

| Description | Sequence | SEQ ID NO: |
|---|---|---|
| | ENDKLIREVKVITLKSKLVSDFRKDFQFYKVREINNYHHAHDAYLNAVVGTALIKKYPK<br>LESEFVYGDYKVYDVRKMIAKSEQEIGKATAKYFFYSNIMNFFKTEITLANGEIRKRPL<br>IETNGETGEIVWDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIMERSSFEKNPID<br>FLEAKGYKEVKKDLIIKLPKYSLFELENGRKRMLASAGELQKGNELALPSKYVNFLYLA<br>SHYEKLKGSPEDNEQKQLFVEQHKHYLDEIIEQISEFSKRVILADANLDKVLSAYNKHR<br>DKPIREQAENIIHLFTLTNLGAPAAFKYFDTTIDRKRYTSTKEVLDATLIHQSITGLYE<br>TRIDLSQLGGDGSPKKKRKVSSDYKDHDGDYKDHDIDYKDDDDKAAG | |
| SpCas9<br>*Streptococcus*<br>*pyogenes*<br>M1GAS wild<br>type<br>NC_002737.2 | ATGGATAAGAAATACTCAATAGGCTTAGATATCGGCACAAATAGCGTCGGATGGGCGGT<br>GATCACTGATGAATATAAGGTTCCGTCTAAAAAGTTCAAGGTTCTGGGAAATACAGACC<br>GCCACAGTATCAAAAAAAATCTTATAGGGGCTCTTTTATTTGACAGTGGAGAGACAGCG<br>GAAGCGACTCGTCTCAAACGGACAGCTCGTAGAAGGTATACACGTCGGAAGAATCGTAT<br>TTGTTATCTACAGGAGATTTTTTCAAATGAGATGGCGAAAGTAGATGATAGTTTCTTTC<br>ATCGACTTGAAGAGTCTTTTTTGGTGGAAGAAGACAAGAAGCATGAACGTCATCCTATT<br>TTTGGAAATATAGTAGATGAAGTTGCTTATCATGAGAAATATCCAACTATCTATCATCT<br>GCGAAAAAAATTGGTAGATTCTACTGATAAAGCGGATTTGCGCTTAATCTATTTGGCCT<br>TAGCGCATATGATTAAGTTTCGTGGTCATTTTTTGATTGAGGGAGATTTAAATCCTGAT<br>AATAGTGATGTGGACAAACTATTTATCCAGTTGGTACAAACCTACAATCAATTATTTGA<br>AGAAAACCCTATTAACGCAAGTGGAGTAGATGCTAAAGCGATTCITTCTGCACGATTGA<br>GTAAATCAAGACGATTAGAAAATCTCATTGCTCAGCTCCCCGGTGAGAAGAAAAATGGC<br>TTATTTGGGAATCTCATTGCTTTGTCATTGGGTTTGACCCCTAATTTTAAATCAAATTT<br>TGATTTGGCAGAAGATGCTAAATTACAGCTTTCAAAAGATACTTACGATGATGATTTAG<br>ATAATTTATTGGCGCAAATTGGAGATCAATATGCTGATTTGTTTTTGGCAGCTAAGAAT<br>TTATCAGATGCTATTTTACTTTCAGATATCCTAAGAGTAAATACTGAAATAACTAAGGC<br>TCCCCTATCAGCTTCAATGATTAAACGCTACGATGAACATCATCAAGACTTGACTCTTT<br>TAAAAGCTTTAGTTCGACAACAACTTCCAGAAAAGTATAAAGAAATCTTTTTTGATCAA<br>TCAAAAAACGGATATGCAGGTTATATTGATGGGGGAGCTAGCCAAGAAGAATTTTATAA<br>ATTTATCAAACCAATTTTAGAAAAAATGGATGGTACTGAGGAATTATTGGTGAAACTAA<br>ATCGTGAAGATTTGCTGCGCAAGCAACGGACCTTTGACAACGGCTCTATTCCCCATCAA<br>ATTCACTTGGGTGAGCTGCATGCTATTTTGAGAAGACAAGAAGACTTTTATCCATTTTT<br>AAAAGACAATCGTGAGAAGATTGAAAAAATCTTGACTTTTCGAATTCCTTATTATGTTG<br>GTCCATTGGCGCGTGGCAATAGTCGTTTTGCATGGATGACTCGGAAGTCTGAAGAAACA<br>ATTACCCCATGGAATTTTGAAGAAGTTGTCGATAAAGGTGCTTCAGCTCAATCATTTAT<br>TGAACGCATGACAAACTTTGATAAAAATCTTCCAAATGAAAAAGTACTACCAAAACATA<br>GTTTGCTTTATGAGTATTTTACGGTTTATAACGAATTGACAAAGGTCAAATATGTTACT<br>GAAGGAATGCGAAAACCAGCATTTCTTTCAGGTGAACAGAAGAAAGCCATTGTTGATTT<br>ACTCTTCAAAACAAATCGAAAAGTAACCGTTAAGCAATTAAAAGAAGATTATTTCAAAA<br>AAATAGAATGTTTTGATAGTGTTGAAATTTCAGGAGTTGAAGATAGATTTAATGCTTCA<br>TTAGGTACCTACCATGATTTGCTAAAAATTATTAAAGATAAAGATTTTTTGGATAATGA<br>AGAAAATGAAGATATCTTAGAGGATATTGTTTTAACATTGACCTTATTTGAAGATAGGG<br>AGATGATTGAGGAAAGACTTAAAACATATGCTCACCTCTTTGATGATAAGGTGATGAAA<br>CAGCTTAAACGTCGCCGTTATACTGGTTGGGGACGTTTGTCTCGAAAATTGATTAATGG<br>TATTAGGGATAAGCAATCTGGCAAAACAATATTAGATTTTTTGAAATCAGATGGTTTTG<br>CCAATCGCAATTTTATGCAGCTGATCCATGATGATAGTTTGACATTTAAAGAAGACATT<br>CAAAAAGCACAAGTGTCTGGACAAGGCGATAGTTTACATGAACATATTGCAAATTTAGC<br>TGGTAGCCCTGCTATTAAAAAAGGTATTTTACAGACTGTAAAAGTTGTTGATGAATTGG<br>TCAAAGTAATGGGGCGGCATAAGCCAGAAAATATCGTTATTGAAATGGCACGTGAAAAT<br>CAGACAACTCAAAAGGGCCAGAAAAATTCGCGAGAGCGTATGAAACGAATCGAAGAAGG<br>TATCAAAGAATTAGGAAGTCAGATTCTTAAAGAGCATCCTGTTGAAAATACTCAATTGC<br>AAAATGAAAAGCTCTATCTCTATTATCTCCAAAATGGAAGAGACATGTATGTGGACCAA<br>GAATTAGATATTAATCGTTTAAGTGATTATGATGTCGATCACATTGTTCCACAAAGTTT<br>CCTTAAAGACGATTCAATAGACAATAAGGTCTTAACGCGTTCTGATAAAAATCGTGGTA<br>AATCGGATAACGTTCCAAGTGAAGAAGTAGTCAAAAAGATGAAAAACTATTGGAGACAA<br>CTTCTAAACGCCAAGTTAATCACTCAACGTAAGITTGATAATTTAACGAAAGCTGAACG<br>TGGAGGTTTGAGTGAACTTGATAAAGCTGGTTTTATCAAACGCCAATTGGTTGAAACTC<br>GCCAAATCACTAAGCATGTGGCACAAATTTTGGATAGTCGCATGAATACTAAATACGAT<br>GAAAATGATAAACTTATTCGAGAGGTTAAAGTGATTACCTTAAAATCTAAATTAGTTTC<br>TGACTTCCGAAAAGATTTCCAATTCTATAAAGTACGTGAGATTAACAATTACCATCATG<br>CCCATGATGCGTATCTAAATGCCGTCGTTGGAACTGCTTTGATTAAGAAATATCCAAAA<br>CTTGAATCGGAGTTTGTCTATGGTGATTATAAAGTTTATGATGTTCGTAAAATGATTGC<br>TAAGTCTGAGCAAGAAATAGGCAAAGCAACCGCAAAATATTTCTTTTACTCTAATATCA<br>TGAACTTCTTCAAAACAGAAATTACACTTGCAAATGGAGAGATTCGCAAACGCCCTCTA<br>ATCGAAACTAATGGGGAAACTGGAGAAATTGTCTGGGATAAAGGGCGAGATTTTGCCAC<br>AGTGCGCAAAGTATTGTCCATGCCCCAAGTCAATATTGTCAAGAAAACAGAAGTACAGA<br>CAGGCGGATTCTCCAAGGAGTCAATTTTACCAAAAAGAAATTCGGACAAGCTTATTGCT<br>CGTAAAAAAGACTGGGATCCAAAAAAATATGGTGGTTTTGATAGTCCAACGGTAGCTTA<br>TTCAGTCCTAGTGGTTGCTAAGGTGGAAAAAGGGAAATCGAAGAAGTTAAAATCCGTTA<br>AAGAGTTACTAGGGATCACAATTATGGAAAGAAGTTCCTTTGAAAAAAATCCGATTGAC<br>TTTTTAGAAGCTAAAGGATATAAGGAAGTTAAAAAAGACTTAATCATTAAACTACCTAA<br>ATATAGTCTTTTTGAGTTAGAAAACGGTCGTAAACGGATGCTGGCTAGTGCCGGAGAAT<br>TACAAAAAGGAAATGAGCTGGCTCTGCCAAGCAAATATGTGAATTTTTTATATTTAGCT<br>AGTCATTATGAAAAGTTGAAGGGTAGTCCAGAAGATAACGAACAAAAACAATTGTTTGT<br>GGAGCAGCATAAGCATTATTTAGATGAGATTATTGAGCAAATCAGTGAATTTTCTAAGC<br>GTGTTATTTTAGCAGATGCCAATTTAGATAAAGTTCTTAGTGCATATAACAAACATAGA<br>GACAAACCAATACGTGAACAAGCAGAAAATATTATTCATTTATTTACGTTGACGAATCT<br>TGGAGCTCCCGCTGCTTTTAAATATTTTGATACAACAATTGATCGTAAACGATATACGT | 34 |

-continued

| Description | Sequence | SEQ ID NO: |
|---|---|---|
| | CTACAAAAGAAGTTTTAGATGCCACTCTTATCCATCAATCCATCACTGGTCTTTATGAA<br>ACACGCATTGATTTGAGTCAGCTAGGAGGTGACTGA | |
| SpCas9<br>*Streptococcus*<br>*pyogenes*<br>M1GAS wild<br>type<br>Encoded<br>product of<br>NC_002737.2<br>(100%<br>identical to<br>the canonical<br>Q99ZW2<br>wild type) | MDKKYSIGLDIGTNSVGWAVITDEYKVPSKKFKVLGNTDRHSIKKNLIGALLFDSGETA<br>EATRLKRTARRRYTRRKNRICYLQEIFSNEMAKVDDSFFHRLEESELVEEDKKHERHPI<br>FGNIVDEVAYHEKYPTIYHLRKKLVDSTDKADLRLIYLALAHMIKFRGHFLIEGDLNPD<br>NSDVDKLFIQLVQTYNQLFEENPINASGVDAKAILSARLSKSRRLENLIAQLPGEKKNG<br>LFGNLIALSLGLTPNFKSNFDLAEDAKLQLSKDTYDDDLDNLLAQIGDQYADLFLAAKN<br>LSDAILLSDILRVNTEITKAPLSASMIKRYDEHHQDLILLKALVRIQLPEKYKEIFFDQ<br>SKNGYAGYIDGGASQEEFYKFIKPILEKMDGTEELLVKLNREDLLRKIRTEDNGSIPHQ<br>IHLGELHAILRRQEDFYPFLKDNREKIEKILTFRIPYYVGPLARGNSRFAWMTRKSEET<br>ITPWNFEEVVDKGASAQSFIERMTNFDKNLPNEKVLPKHSLLYEYFTVYNELTKVKYVT<br>EGMRKPAFLSGEQKKAIVDLLFKTNRKVTVKILKEDYFKKIECFDSVEISGVEDRENAS<br>LGTYHDLLKIIKDKDELDNEENEDILEDIVLTLTLFEDREMIEERLKTYAHLEDDKVMK<br>QLKRRRYTGWGRLSRKLINGIRDKQSGKTILDFLKSDGFANRNFMQLIHDDSLTFKEDI<br>QKAQVSGQGDSLHEHIANLAGSPAIKKGILQTVKVVDELVKVMGRHKPENIVIEMAREN<br>QTTQKGQKNSRERMKRIEEGIKELGSQILKEHPVENTQLQNEKLYLYYLINGRDMYVDQ<br>ELDINRLSDYDVDHIVPQSFLKDDSIDNKVLTRSDKNRGKSDNVPSEEVVKKMKNYWRQ<br>LLNAKLITIRKFDNLTKAERGGLSELDKAGFIKRQLVETRIITKHVAQILDSRMNTKYD<br>ENDKLIREVKVITLKSKLVSDFRKDFQFYKVREINNYHHAHDAYLNAVVGTALIKKYPK<br>LESEFVYGDYKVYDVRKMIAKSEQEIGKATAKYFFYSNIMNFFKTEITLANGEIRKRPL<br>IETNGETGEIVWDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIMERSSFEKNPID<br>FLEAKGYKEVKKDLIIKLPKYSLFELENGRKRMLASAGELQKGNELALPSKYVNFLYLA<br>SHYEKLKGSPEDNEQKQLFVEQHKHYLDEIIEQISEFSKRVILADANLDKVLSAYNKHR<br>DKPIREQAENIIHLFTLTNLGAPAAFKYFDTTIDRKRYTSTKEVLDATLIHQSITGLYE<br>TRIDLSQLGGD | 35 |

The base editors described herein may include any of the above SpCas9 sequences, or any variant thereof having at least 80%, at least 85%, at least 90%, at least 95%, or at least 99% sequence identity thereto.

(2) Wild Type Cas9 Orthologs

In other embodiments, the Cas9 protein can be a wild type Cas9 ortholog from another bacterial species. For example, the following Cas9 orthologs can be used in connection with the base editor constructs described in this specification. In addition, any variant Cas9 orthologs having at least 80%, at least 85%, at least 90%, at least 95%, or at least 99% sequence identity to an of the below orthologs may also be used with the resent base editors.

| Description | Sequence |
|---|---|
| LfCas9<br>*Lactobacillus*<br>*fermentum*<br>wild type<br>GenBank:<br>SNX31424.11 | MKEYHIGLDIGTSSIGWAVTDSQFKLMRIKGKTAIGVRLFEEGKTAAERRTFRTTRRRLKRRKWRLHYLDEIFAPHLQEVD<br>ENFLRRLKQSNIHPEDPTKNQAFIGKLLFPDLLKKNERGYPTLIKMRDELPVEQRAHYPVMNIYKLREAMINEDRQFDLRE<br>VYLAVHHIVKYRGHFLNNASVDKFKVGRIDFDKSFNVLNEAYEELQNGEGSFTIEPSKVEKIGQLLLDTKMRKLDRQKAVA<br>KLLEVKVADKEETKRNKQIATAMSKLVLGYKADFATVAMANGNEWKIDLSSETSEDEIEKFREELSDAQNDILTEITSLFS<br>QIMLNEIVPNGMSISESMMDRYWTHERQLAEVKEYLATQPASARKEFDQVYNKYIGQAPKERGFDLEKGLKKILSKKENWK<br>EIDELLKAGDFLPKQRTSANGVIPHQMHQQELDRIIEKQAKYYPWLATENPATGERDRHQAKYELDQLVSFRIPYYVGPLV<br>TPEVQKATSGAKFAWAKRKEDGEITPWNLWDKIDRAESAEAFIKRMTVKDTYLLNEDVLPANSLLYQKYNVLNELNNVRVN<br>GRRLSVGIKQDIYTELFKKKKTVKASDVASLVMAKTRGVNKPSVEGLSDPKKFNSNLATYLDLKSIVGDKVDDNRYQTDLE<br>NIIEWRSVFEDGEIFADKLTEVEWLTDEQRSALVKKRYKGWGRLSKKLLTGIVDENGQRIIDLMWNTDQNFKEIVDQPVFK<br>EQIDQLNQKAITNDGMTLRERVESVLDDAYTSPQNKKAIWQVVRVVEDIVKAVGNAPKSISIEFARNEGNKGEITRSRRTQ<br>LQKLFEDQAHELVKDTSLTEELEKAPDLSDRYYFYFTQGGKDMYTGDPINFDEISTKYDIDHILPQSFVKDNSLDNRVLTS<br>RKENNKKSDQVPAKLYAAKMKPYWNQLLKQGLITQRKFENLTKDVDQNIKYRSLGFVKRQLVETRQVIKLTANILGSMYQE<br>AGTEIIETRAGLTKQLREEFDLPKVREVNDYHHAVDAYLTTFAGQYLNRRYPKLRSFFVYGEYMKFKHGSDLKLRNFNFFH<br>ELMEGDKSQGKVVDQQTGELITTRDEVAKSFDRLLNMKYMLVSKEVHDRSDQLYGATIVTAKESGKLTSPIEIKKNRLVDL<br>YGAYTNGTSAFMTIIKFTGNKPKYKVIGIPTTSAASLKRAGKPGSESYNQELHRIIKSNPKVKKGFEIVVPHVSYGQLIVD<br>GDCKFTLASPTVQHPATQLVLSKKSLETISSGYKILKDKPAIANERLIRVFDEVVGQMNRYFTIFDQRSNRQKVADARDKF<br>LSLPTESKYEGAKKVQVGKTEVITNLLMGLHANATQGDLKVLGLATFGFFQSTTGLSLSEDTMIVYQSPTGLFERRICLKD<br>I (SEQ ID NO: 36) |
| SaCas9<br>*Staphylococcus*<br>*aureus*<br>wild type<br>GenBank:<br>AYD60528.1 | MDKKYSIGLDIGTNSVGWAVITDEYKVPSKKFKVLGNTDRHSIKKNLIGALLFDSGETAEATRLKRTARRRYTRRKNRICY<br>LQEIFSNEMAKVDDSFFHRLEESFLVEEDKKHERHPIFGNIVDEVAYHEKYPTIYHLRKKLVDSTDKADLRLIYLALAHMI<br>KFRGHFLIEGDLNPDNSDVDKLFIQLVQTYNQLFEENPINASGVDAKAILSARLSKSRRLENLIAQLPGEKKNGLFGNLIA<br>LSLGLTPNFKSNFDLAEDAKLQLSKDTYDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIKPILEKMDGTEELLVKLNREDLLRKQRTF<br>DNGSIPHQIHLGELHAILRRQEDFYPFLKDNREKIEKILTFRIPYYVGPLARGNSRFAWMTRKSEETITPWNFEEVVDKGA<br>SAQSFIERMTNFDKNLPNEKVLPKHSLLYEYFTVYNELTKVKYVTEGMRKPAFLSGEQKKAIVDLLFKTNRKVTVKQLKED<br>YFKKIECFDSVEISGVEDRFNASLGTYHDLLKIIKDKDFLDNEENEDILEDIVLTLTLFEDREMIEERLKTYAHLFDDKVM<br>KQLKRRRYTGWGRLSRKLINGIRDKQSGKTILDFLKSDGFANRNFMQLIHDDSLTFKEDIQKAQVSGQGDSLHEHIANLAG<br>SPAIKKGILQTVKVVDELVKVMGRHKPENIVIEMARENQTTQKGQKNSRERMKRIEEGIKELGSQILKEHPVENTQLQNEK<br>LYLYYLQNGRDMYVDQELDINRLSDYDVDHIVPQSFLKDDSIDNKVLTRSDKNRGKSDNVPSEEVVKKMKNYWRQLLNAKL<br>ITQRKFDNLTKAERGGLSELDKAGFIKRQLVETRQITKHVAQILDSRMNTKYDENDKLIREVKVITLKSKLVSDFRKDFQF<br>YKVREINNYHHAHDAYLNAVVGTALIKKYPKLESEFVYGDYKVYDVRKMIAKSEQEIGKATAKYFFYSNIMNFFKTEITLA<br>NGEIRKRPLIETNGETGEIVWDKGRDFATVRKVLSMPQVNIVKKTEVQTGGFSKESILPKRNSDKLIARKKDWDPKKYGGF |

-continued

| Description | Sequence |
|---|---|
| | DSPTVAYSVLVVAKVEKGKSKKLKSVKELLGITIMERSSFEKNPIDFLEAKGYKEVKKDLIIKLPKYSLFELENGRKRMLA<br>SAGELQKGNELALPSKYVNFLYLASHYEKLKGSPEDNEQKQLFVEQHKHYLDEIIEQISEFSKRVILADANLDKVLSAYNK<br>HRDKPIREQAENI IHLFTLTNLGAPAAFKYFDTTIDRKRYTSTKEVLDATLIHQSITGLYETRIDLSQLGGD<br>(SEQ ID NO: 37) |
| SaCas9<br>*Staphylococcus aureus* | MGKRNYILGLDIGITSVGYGIIDYETRDVIDAGVRLFKEANVENNEGRRSKRGARRLKRRRRHRIQRVKKLLFDYNLLTDH<br>SELSGINPYEARVKGLSQKLSEEEFSAALLHLAKRRGVHNVNEVEEDTGNELSTKEQISRNSKALEEKYVAELQLERLKKD<br>GEVRGSINRFKTSDYVKEAKQLLKVQKAYHQLDQSFIDTYIDLLETRRTYYEGPGEGSPFGWKDIKEWYEMLMGHCTYFPE<br>ELRSVKYAYNADLYNALNDLNNLVITRDENEKLEYYEKFQIIENVFKQKKKPTLKQIAKEILVNEEDIKGYRVTSTGKPEF<br>TNLKVYHDIKDITARKEIIENAELLDQIAKILTIYQSSEDIQEELTNLNSELTQEEIEQISNLKGYTGTHNLSLKAINLIL<br>DELWHTNDNQIAIFNRLKLVPKKVDLSQQKEIPTTLVDDFILSPVVKRSFIQSIKVINAIIKKYGLPNDIIIELAREKNSK<br>DAQKMINEMQKRNRQTNERIEEIIRTTGKENAKYLIEKIKLHDMQEGKCLYSLEAIPLEDLLNNPFNYEVDHIIPRSVSFD<br>NSFNNKVLVKQEENSKKGNRTPFQYLSSSDSKISYETFKKHILNLAKGKGRISKTKKEYLLEERDINRFSVQKDFINRNLV<br>DTRYATRGLMNLLRSYFRVNNLDVKVKSINGGFTSFLRRKWKFKKERNKGYKHHAEDALIIANADFIFKEWKKLDKAKKVM<br>ENQMFEEKQAESMPEIETEQEYKEIFITPHQIKHIKDFKDYKYSHRVDKKPNRKLINDTLYSTRKDDKGNTLIVNNLNGLY<br>DKDNDKLKKLINKSPEKLLMYHHDPQTYQKLKLIMEQYGDEKNPLYKYYEETGNYLTKYSKKDNGPVIKKIKYYGNKLNAH<br>LDITDDYPNSRNKVVKLSLKPYRFDVYLDNGVYKFVTVKNLDVIKKENYYEVNSKCYEEAKKLKKISNQAEFIASFYKNDL<br>IKINGELYRVIGVNNDLLNRIEVNMIDITYREYLENMNDKRPPHIIKTIASKTQSIKKYSTDILGNLYEVKSKKHPQIIKK<br>(SEQ ID NO: 38) |
| StCas9<br>*Streptococcus thermophilus*<br>UniProtKB/<br>Swiss-Prot:<br>G3ECR1.2<br>Wild type | MLFNKCIIISINLDFSNKEKCMTKPYSIGLDIGTNSVGWAVITDNYKVPSKKMKVLGNTSKKYIKKNLLGVLLFDSGITAE<br>GRRLKRTARRRYTRRRNRILYLQEIFSTEMATLDDAFFQRLDDSFLVPDDKRDSKYPIFGNLVEEKVYHDEFPTIYHLRKY<br>LADSTKKADLRLVYLALAHMIKYRGHFLIEGEFNSKNNDIQKNFQDFLDTYNAIFESDLSLENSKQLEEIVKDKISKLEKK<br>DRILKLFPGEKNSGIFSEFLKLIVGNQADFRKCFNLDEKASLHFSKESYDEDLETLLGYIGDDYSDVFLKAKKLYDAILLS<br>GFLTVTDNETEAPLSSAMIKRYNEHKEDLALLKEYIRNISLKTYNEVFKDDTKNGYAGYIDGKTNQEDFYVYLKNLLAEFE<br>GADYFLEKIDREDFLRKQRTFDNGSIPYQIHLQEMRAILDKQAKFYPFLAKNKERIEKILTFRIPYYVGPLARGNSDFAWS<br>IRKRNEKITPWNFEDVIDKESSAEAFINRMTSFDLYLPEEKVLPKHSLLYETFNVYNELTKVRFIAESMRDYQFLDSKQKK<br>DIVRLYFKDKRKVTDKDIIEYLHAIYGYDGIELKGIEKQFNSSLSTYHDLLNIINDKEFLDDSSNEAIIEEIIHTLTIFED<br>REMIKQRLSKFENIFDKSVLKKLSRRHYTGWGKLSAKLINGIRDEKSGNTILDYLIDDGISNRNFMQLIHDDALSFKKKIQ<br>KAQIIGDEDKGNIKEVVKSLPGSPAIKKGILQSIKIVDELVKVMGGRKPESIVVEMARENQYTNQGKSNSQQRLKRLEKSL<br>KELGSKILKENIPAKLSKIDNNALQNDRLYLYYLQNGKDMYTGDDLDIDRLSNYDIDHIIPQAFLKDNSIDNKVLVSSASN<br>RGKSDDFPSLEVVKKRKTFWYQLLKSKLISQRKFDNLTKAERGGLLPEDKAGFIQRQLVETRQITKHVARLLDEKENNKKD<br>ENNRAVRTVKIITLKSTLVSQFRKDFELYKVREINDFHHAHDAYLNAVIASALLKKYPKLEPEFVYGDYPKYNSFRERKSA<br>TEKVYFYSNIMNIFKKSISLADGRVIERPLIEVNEETGESVWNKESDLATVRRVLSYPQVNVVKKVEEQNHGLDRGKPKGL<br>FNANLSSKPKPNSNENLVGAKEYLDPKKYGGYAGISNSFAVLVKGTIEKGAKKKITNVLEFQGISILDRINYRKDKLNFLL<br>EKGYKDIELIIELPKYSLFELSDGSRRMLASILSTNNKRGEIHKGNQIFLSQKFVKLLYHAKRISNTINENHRKYVENHKK<br>EFEELFYYILEFNENYVGAKKNGKLLNSAFQSWQNHSIDELCSSFIGPTGSERKGLFELTSRGSAADFEFLGVKIPRYRDY<br>TPSSLLKDATLIHQSVTGLYETRIDLAKLGEG (SEQ ID NO: 39) |
| LcCas9<br>*Lactobacillus crispatus*<br>NCBI<br>Reference<br>Sequence:<br>WP_133478044.1<br>Wild type | MKIKNYNLALTPSTSAVGHVEVDDDLNILEPVHHQKAIGVAKFGEGETAEARRLARSARRTTKRRANRINHYFNEIMKPEI<br>DKVDPLMFDRIKQAGLSPLDERKEFRTVIFDRPNIASYYHNQFPTIWHLQKYLMITDEKADIRLIYWALHSLLKHRGHFFN<br>TTPMSQFKPGKLNLKDDMLALDDYNDLEGLSFAVANSPEIEKVIKDRSMHKKEKIAELKKLIVNDVPDKDLAKRNNKIITQ<br>IVNAIMGNSFHLNFIFDMDLDKLTSKAWSFKLDDPELDTKFDAISGSMTDNQIGIFETLQKIYSAISLLDILNGSSNVVDA<br>KNALYDKHKRDLNLYFKFLNTLPDEIAKTLKAGYTLYIGNRKKDLLAARKLLKVNVAKNFSQDDFYKLINKELKSIDKQGL<br>QTRFSEKVGELVAQNNFLPVQRSSDNVFIPYQLNAITFNKILENQGKYYDFLVKPNPAKKDRKNAPYELSQLMQFTIPYYV<br>GPLVTPEEQVKSGIPKTSRFAWMVRKDNGAITPWNFYDKVDIEATADKFIKRSIAKDSYLLSELVLPKHSLLYEKYEVENE<br>LSNVSLDGKKLSGGVKQILFNEVFKKTNKVNTSRILKALAKHNIPGSKITGLSNPEEFTSSLQTYNAWKKYFPNQIDNFAY<br>QQDLEKMIEWSTVFEDHKILAKKLDEIEWLDDDQKKFVANTRLRGWGRLSKRLLTGLKDNYGKSIMQRLETTKANFQQIVY<br>KPEFREQIDKISQAAAKNQSLEDILANSYTSPSNRKAIRKTMSVVDEYIKLNHGKEPDKIFLMFQRSEQEKGKQTEARSKQ<br>LNRILSQLKADKSANKLFSKQLADEFSNAIKKSKYKLNDKQYFYFQQLGRDALTGEVIDYDELYKYTVLHIIPRSKLTDDS<br>QNNKVLTKYKIVDGSVALKFGNSYSDALGMPIKAFWTELNRLKLIPKGKLLNLTTDFSTLNKYQRDGYIARQLVETQQIVK<br>LLATIMQSRFKHTKIIEVRNSQVANIRYQFDYFRIKNLNEYYRGFDAYLAAVVGTYLYKVYPKARRLFVYGQYLKPKKTNQ<br>ENQDMHLDSEKKSQGFNFLWNLLYGKQDQIFVNGTDVIAFNRKDLITKMNTVYNYKSQKISLAIDYHNGAMFKATLFPRND<br>RDTAKTRKLIPKKKDYDTDIYGGYTSNVDGYMLLAEIIKRDGNKQYGFYGVPSRLVSELDTLKKTRYTEYEEKLKEIIKPE<br>LGVDLKKIKKIKILKNKVPFNQVIIDKGSKFFITSTSYRWNYRQLILSAESQQTLMDLVVDPDFSNHKARKDARKNADERL<br>IKVYEEILYQVKNYMPMFVELHRCYEKLVDAQKTFKSLKISDKAMVLNQILILLHSNATSPVLEKLGYHTRFTLGKKHNLI<br>SENAVLVTQSITGLKENHVSIKQML (SEQ ID NO: 40) |
| PdCas9<br>*Pedicoccus damnosus*<br>NCBI<br>Reference<br>Sequence:<br>WP_062913273.1<br>Wild type | MTNEKYSIGLDIGTSSIGFAVVNDNNRVIRVKGKNAIGVRLFDEGKAAADRRSFRTTRRSFRTTRRRLSRRRWRLKLLREI<br>FDAYITPVDEAFFIRLKESNLSPKDSKKQYSGDILFNDRSDKDFYEKYPTIYHLRNALMTEHRKFDVREIYLAIHHIMKFR<br>GHFLNATPANNFKVGRLNLEEKFEELNDIYQRVFPDESIEFRTDNLEQIKEVLLDNKRSRADRQRTLVSDIYQSSEDKDIE<br>KRNKAVATEILKASLGNKAKLNVITNVEVDKEAAKEWSITFDSESIDDDLAKIEGQMTDDGHEIIEVLRSLYSGITLSAIV<br>PENHTLSQSMVAKYDLHKDHLKLFKKLINGMTDTKKAKNLRAAYDGYIDGVKGKVLPQEDFYKQVQVNLDDSAEANEIQTY<br>IDQDIFMPKQRTKANGSIPHQLQQELDQIIENQKAYYPWLAELNPNPDKKRQQLAKYKLDELVTFRVPYYVGPMITAKDQ<br>KNQSGAEFAWMIRKEPGNITPWNFDQKVDRMATANQFIKRMTTTDTYLLGEDVLPAQSLLYQKFEVLNELNKIRIDHKPIS<br>IEQKQQIFNDLFKQFKNVTIKHLQDYLVSQGQYSKRPLIEGLADEKRFNSSLSTYSDLCGIFGAKLVEENDRQEDLEKIIE<br>WSTIFEDKKIYRAKLNDLTWLTDDQKEKLATKRYQGWGRLSRKLLVGLKNSEHRNIMDILWITNENFMQIQAEPDFAKLVT<br>DANKGMLEKTDSQDVINDLYTSPQNKKAIRQILLVVHDIQNAMHGQAPAKIHVEFARGEERNPRRSVQRQRQVEAAYEKVS<br>NELVSAKVRQEFKEAINNKRDFKDRLFLYFMQGGIDIYTGKQLNIDQLSSYQIDHILPQAFVKDDSLTNRVLTNENQVKAD<br>SVPIDIFGKKMLSVWGRMKDQGLISKGKYRNLTMNPENISAHTENGFINRQLVETRQVIKLAVNILADEYGDSTQIISVKA<br>DLSHQMREDFELLKNRDVNDYHHAFDAYLAAFIGNYLLKRYPKLESYFVYGDFKKFTQKETKMRRFNFIYDLKHCDQVVNK<br>ETGEILWTKDEDIKYIRHLFAYKKILVSHEVREKRGALYNQTIYKAKDDKGSGQESKKLIRIKDDKETKIYGGYSGKSLAY<br>MTIVQITKKNKVSYRVIGIPTLALARLNKLENDSTENNGELYKIIKPQFTHYKVDKKNGEIIETTDDFKIVVSKVRFQQLI<br>DDAGQFFMLASDTYKNNAQQLVISNNALKAINNTNITDCPRDDLERLDNLRLDSAFDEIVKKMDKYFSAYDANNFREKIRN<br>SNLIFYQLPVEDQWENNKITELGKRTVLTRILQGLHANATTDMSIFKIKTPFGQLRQRSGISLSENAQLIYQSPTGLFER<br>RVQLNKIK (SEQ ID NO: 41) |

-continued

| Description | Sequence |
|---|---|
| FnCas9<br>Fusobaterium<br>*nucleatum*<br>NCBI<br>Reference<br>Sequence:<br>WP_060798984.1 | MKKQKFSDYYLGFDIGTNSVGWCVTDLDYNVLRFNKKDMWGSRLFEEAKTAAERRVQRNSRRRLKRRKWRLNLLEEIFSNE<br>ILKIDSNFFRRLKESSLWLEDKSSKEKFTLENDDNYKDYDFYKQYPTIFHLRNELIKNPEKKDIRLVYLAIHSIFKSRGHF<br>LFEGQNLKEIKNFETLYNNLIAFLEDNGINKIIDKNNIEKLEKIVCDSKKGLKDKEKEFKEIFNSDKQLVAIFKLSVGSSV<br>SLNDLFDTDEYKKGEVEKEKISFREQIYEDDKPIYYSILGEKIELLDIAKTFYDFMVLNNILADSQYISEAKVKLYEEHKK<br>DLKNLKYIIRKYNKGNYDKLFKDKNENNYSAYIGLNKEKSKKEVIEKSRLKIDDLIKNIKGYLPKVEEIEEKDKAIFNKIL<br>NKIELKTILPKQRISDNGTLPYQIHEAELEKILENQSKYYDFLNYEENGIITKDKLLMTFKFRIPYYVGPLNSYHKDKGGN<br>SWIVRKEEGKILPWNFEQKVDIEKSAEEFIKRMTNKCTYLNGEDVIPKDTFLYSEYVILNELNKVQVNDEFLNEENKRKII<br>DELFKENKKVSEKKFKEYLLVKQIVDGTIELKGVKDSFNSNYISYIRFKDIFGEKLNLDIYKEISEKSILWKCLYGDDKKI<br>FEKKIKNEYGDILTKDEIKKINTFKFNNWGRLSEKLLTGIEFINLETGECYSSVMDALRRTNYNLMELLSSKFTLQESINN<br>ENKEMNEASYRDLIEESYVSPSLKRAIFQTLKIYEEIRKITGRVPKKVFIEMARGGDESMKNKKIPARQEQLKKLYDSCGN<br>DIANFSIDIKEMKNSLISYDNNSLRQKKLYLYYLQFGKCMYTGREIDLDRLLQNNDTYDIDHIYPRSKVIKDDSFDNLVLV<br>LKNENAEKSNEYPVKKEIQEKMKSFWRFLKEKNFISDEKYKRLTGKDDFELRGFMARQLVNVRQTTKEVGKILQQIEPEIK<br>IVYSKAEIASSFREMFDFIKVRELNDTHHAKDAYLNIVAGNVYNTKFTEKPYRYLQEIKENYDVKKIYNYDIKNAWDKENS<br>LEIVKKNMEKNTVNITRFIKEKKGQLFDLNPIKKGETSNEIISIKPKVYNGKDDKLNEKYGYYKSLNPAYFLYVEHKEKNK<br>RIKSFERVNLVDVNNIKDEKSLVKYLIENKKLVEPRVIKKVYKRQVILINDYPYSIVTLDSNKLMDFENLKPLFLENKYEK<br>ILKNVIKFLEDNQGKSEENYKFIYLKKKDRYEKNETLESVKDRYNLEFNEMYDKFLEKLDSKDYKNYMNNKKYQELLDVKE<br>KFIKLNLFDKAFTLKSFLDLFNRKTMADFSKVGLTKYLGKIQKISSNVLSKNELYLLEESVTGLFVKKIKI (SEQ ID<br>NO: 42) |
| EcCas9<br>*Enterococcus*<br>*cecorum*<br>NCBI<br>Reference<br>Sequence:<br>WP_047338501.1<br>Wild type | MNKYYLGLDMGSASVGWAVTDENYHLVRRKGKDLWGVRTFDVAQTAKERRITRGNRRRQDRRKQRIQILQELLGEEVLKTD<br>PGFFHRMKESRYVVEDKRTLDGKQVELPYALFVDKDYTDKEYYKQFPTINHLIVYLMTTSDTPDIRLVYLALHYYMKNRGN<br>FLHSGDINNVKDINDILEQLDNVLETFLDGWNLKLKSYVEDIKNIYNRDLGRGERKKAFVNTLGAKTKAEKAFCSLISGGS<br>TNLAELFDDSSLKEIETPKIEFASSSLEDKIDGIQEALEDRFAVIEAAKRLYDWKTLTDILGDSSSLAEARVNSYQMHHEQ<br>LLELKSLVKEYLDRKVFQEVFVSLNVANNYPAYIGHTKINGKKKELEVKRTKRNDFYSVVKKQVIEPIKKKVSDEAVLTKL<br>SEIESLIEVDKYLPLQVNSDNGVIPYQVKLNELTRIFDNLENRIPVLRENRDKIIKTFKFRIPYYVGSLNGVVKNGKCTNW<br>MVRKEEGKIYPWNFEDKVDLEASAEQFIRRMTNKCTYLVNEDVLPKYSLLYSKYLVLSELNNLRIDGRPLDVKIKQDIYEN<br>VFKKNRKVTLKKIKKYLLKEGIITDDDALSGLADDVKSSLTAYRDFKEKLGHLDLSEAQMENIILNITLFGDDKKLLKKRL<br>AALYPFIDDKSLNRIATLNYRDWGRLSERFLSGITSVDQETGELRTIIQCMYETQANLMQLLAEPYHFVEAIEKENPKVDL<br>ESISYRIVNDLYVSPAVKRQIWQTLLVIKDIKQVMKHDPERIFIEMAREKQESKKTKSRKQVLSEVYKKAKEYEHLFEKLN<br>SLTEEQLRSKKIYLYFTQLGKCMYSGEPIDFENLVSANSNYDIDHIYPQSKTIDDSFNNIVLVKKSLNAYKSNHYPIDKNI<br>RDNEKVKTLWNTLVSKGLITKEKYERLIRSTPFSDEELAGFIARQLVETRQSTKAVAEILSNWFPESEIVYSKAKNVSNER<br>QDFEILKVRELNDCHHAHDAYLNIVVGNAYHTKFTNSPYRFIKNKANQEYNLRKLLQKVNKIESNGVVAWVGQSENNPGTI<br>ATVKKVIRRNTVLISRMVKEVDGQLFDLTLMKKGKGQVPIKSSDERLTDISKYGGYNKATGAYFTFVKSKKRGKVVRSFEY<br>VPLHLSKQFENNNELLKEYIEKDRGLTDVEILIPKVLINSLFRYNGSLVRITGRGDTRLLLVHEQPLYVSNSFVQQLKSVS<br>SYKLKKSENDNAKLTKTATEKLSNIDELYDGLLRKLDLPIYSYWFSSIKEYLVESRTKYIKLSIEEKALVIFEILHLFQSD<br>AQVPNLKILGLSTKPSRIRIQKNLKDTDKMSIIHQSPSGIFEHEIELTSL (SEQ ID NO: 444) |
| AhCas9<br>*Anaerostipes*<br>*hadrus*<br>NCBI<br>Reference<br>Sequence:<br>WP_044924278.1<br>Wild type | MQNGFLGITVSSEQVGWAVTNPKYELERASRKDLWGVRLFDKAETAEDRRMFRTNRRLNQRKKNRIHYLRDIFHEEVNQKD<br>PNFFQQLDESNFCEDDRIVEFNFDTNLYKNQFPTVYHLRKYLMETKDKPDIRLVYLAFSKFMKNRGHFLYKGNLGEVMDFE<br>NSMKGFCESLEKFNIDFPTLSDEQVKEVRDILCDHKIAKTVKKKNIITITKVKSKTAKAWIGLFCGCSVPVKVLFQDIDEE<br>IVTDPEKISFEDASYDDYIANIEKGVGIYYEAIVSAKMLFDWSILNEILGDHQLLSDAMIAEYNKHHDDLKRLQKIIKGTG<br>SRELYQDIFINDVSGNYVCYVGHAKTMSSADQKQFYTFLKNRLKNVNGISSEDAEWIDTEIKNGTLLPKQTKRDNSVIPHQ<br>LQLREFELILDNMQEMYPFLKENREKLLKIFNFVIPYYVGPLKGVVRKGESTNWMVPKKDGVIHPWNFDEMVDKEASAECF<br>ISRMTGNCSYLFNEKVLPKNSLLYETFEVLNELNPLKINGEPISVELKQRIYEQLFLTGKKVTKKSLTKYLIKNGYDKDIE<br>LSGIDNEFHSNLKSHIDFEDYDNLSDEEVEQIILRITVFEDKQLLKDYLNREFVKLSEDERKQICSLSYKGWGNLSEMLLN<br>GITVTDSNGVEVSVMDMLWNTNLNLMQILSKKYGYKAEIEHYNKEHEKTIYNREDLMDYLNIPPAQRRKVNQLITIVKSLK<br>KTYGVPNKIFFKISREHQDDPKRTSSRKEQLKYLYKSLKSEDEKHLMKELDELNDHELSNDKVYLYFLQKGRCIYSGKKLN<br>LSRLRKSNYQNDIDYIYPLSAVNDRSMNNKVLTGIQENRADKYTYFPVDSEIQKKMKGFWMELVLQGFMTKEKYFRLSREN<br>DFSKSELVSFIEREISDNQQSGRMIASVLQYYFPESKIVFVKEKLISSFKRDFHLISSYGHNHLQAAKDAYITIVVGNVYH<br>TKFTMDPAIYFKNHKRKDYDLNRLFLENISRDGQIAWESGPYGSIQTVRKEYAQNHIAVTKRVVEVKGGLFKQMPLKKGHG<br>EYPLKTNDPRFGNIAQYGGYTNVTGSYFVLVESMEKGKKRISLEYVPVYLHERLEDDPGHKLLKEYLVDHRKLNHPKILLA<br>KVRKNSLLKIDGFYYRLNGRSGNALILTNAVELIMDDWQTKTANKISGYMKRRAIDKKARVYQNEFHIQELEQLYDFYLDK<br>LKNGVYKNRKNNQAELIHNEKEQFMELKTEDQCVLLTEIKKLFVCSPMQADLTLIGGSKHTGMIAMSSNVTKADFAVIAED<br>PLGLRNKVIYSHKGEK (SEQ ID NO: 44) |
| KvCas9<br>*Kandleria*<br>*vitulina*<br>NCBI<br>Reference<br>Sequence:<br>WP_031589969.1<br>Wild type | MSQNNNKIYNIGLDIGDASVGWAVVDEHYNLLKRHGKHMWGSRLFTQANTAVERRSSRSTRRRYNKRRERIRLLREIMEDM<br>VLDVDPTFFIRLANVSFLDQEDKKDYLKENYHSNYNLFIDKDFNDKTYYDKYPTIYHLRKHLCESKEKEDPRLIYLALHHI<br>VKYRGNFLYEGQKFSMDVSNIEDKMIDVLRQFNEINLFEYVEDRKKIDEVLNVLKEPLSKKHKAEKAFALFDTTKDNKAAY<br>KELCAALAGNKFNVTKMLKEAELHDEDEKDISFKFSDATFDDAFVEKQPLLGDCVEFIDLLHDIYSWVELQNILGSAHTSE<br>PSISAAMIQRYEDHKNDLKLLKDVIRKYLPKKYFEVFRDEKSKKNNYCNYINHPSKTPVDEFYKYIKKLIEKIDDPDVKTI<br>LNKIELESFMLKQNSRINGAVPYQMQLDELNKILENQSVYYSDLKDNEDKIRSILTFRIPYYFGPLNITKDRQFDWIIKKE<br>GKENERILPWNANEIVDVDKTADEFIKRMRNFCTYFPDEPVMAKNSLTVSKYEVLNEINKLRINDHLIKRDMKDKMLHTLF<br>MDHKSISANAMKKWLVKNQYFSNTDDIKIEGFQKENACSTSLTPWIDFTKIFGKINESNYDFIEKIIYDVTVFEDKKILRR<br>RLKKEYDLDEEKIKKILKLKYSGWSRLSKKLLSGIKTKYKDSTRTPETVLEVMERTNMNLMQVINDEKLGFKKTIDDANST<br>SVSGKFSYAEVQELAGSPAIKRGIWQALLIVDEIKKIMKHEPAHVYIEFARNEDEKERKDSFVNQMLKLYKDYDFEDETEK<br>EANKHLKGEDAKSKIRSERLKLYYTQMGKCMYTGKSLDIDRLDTYQVDHIVPQSLLKDDSIDNKVLVLSSENQRKLDDLVI<br>PSSIRNKMYGFWEKLFNNKIISPKKFYSLIKTEFNEKDQERFINRQIVETRQITKHVAQIIDNHYENTKVVTVRADLSHQF<br>RERYHIYKNRDINDFHHAHDAYIATILGTYIGHRFESLDAKYIYGEYKRIFRNQKNKGKEMKKNNDGFILNSMRNIYADKD<br>TGEIVWDPNYIDRIKKCFYYKDCFVTKKLEENNGTFFNVTVLPNDTNSDKDNTLATVPVNKYRSNVNKYGGFSGVNSFIVA<br>IKGKKKKGKKVIEVNKLTGIPLMYKNADEEIKINYLKQAEDLEEVQIGKEILKNQLIEKDGGLYYIVAPTEIINAKQLILN<br>ESQTKLVCEIYKAMKYKNYDNLDSEKIIDLYRLLINKMELYYPEYRKQLVKKFEDRYEQLKVISIEEKCNIIKQILATLHC<br>NSSIGKIMYSDFKISTTIGRINGRTISLDDISFIAESPTGMYSKKYKL (SEQ ID NO: 45) |
| EfCas9<br>*Enterococcus*<br>*faecalis*<br>NCBI | MRLFEEGHTAEDRRLKRTARRRISRRRNRLRYLQAFFEEAMTDLDENFFARLQESFLVPEDKKWHRHP IFAKLEDEVAYHE<br>TYPTIYHLRKKLADSSEQADLRLIYLALAHIVKYRGHFLIEGKLSTENTSVKDQFQQFMVIYNQTFVNGESRLVSAPLPES<br>VLIEEELTEKASRTKKSEKVLQQFPQEKANGLFGQFLKLMVGNKADFKKVFGLEEEAKITYASESYEEDLEGILAKVGDEY<br>SDVFLAAKNVYDAVELSTILADSDKKSHAKLSSSMIVRFTEHQEDLKKFKRFIRENCPDEYDNLFKNEQKDGYAGYIAHAG |

-continued

| Description | Sequence |
|---|---|
| Reference Sequence: WP_016631044.1 Wild type | KVSQLKFYQYVKKIIQDIAGAEYFLEKIAQENFLRKQRTFDNGVIPHQIHLAELQAIIHRQAAYYPFLKENQEKIEQLVTF RIPYYVGPLSKGDASTFAWLKRQSEEPIRPWNLQETVDLDQSATAFIERMTNFDTYLPSEKVLPKHSLLYEKFMVFNELTK ISYTDDRGIKANFSGKEKEKIFDYLFKTRRKVKKKDIIQFYRNEYNTEIVTLSGLEEDQFNASFSTYQDLLKCGLTRAELD HPDNAEKLEDIIKILTIFEDRQRIRTQLSTFKGQFSAEVLKKLERKHYTGWGRLSKKLINGIYDKESGKTILDYLVKDDGV SKHYNRNFMQLINDSQLSFKNAIQKAQSSEHEETLSETVNELAGSPAIKKGIYQSLKIVDELVAIMGYAPKRIVVEMAREN QTTSTGKRRSIQRLKIVEKAMAEIGSNLLKEQPTTNEQLRDTRLFLYYMQNGKDMYTGDELSLHRLSHYDIDHIIPQSFMK DDSLDNLVLVGSTENRGKSDDVPSKEVVKDMKAYWEKLYAAGLISQRKFQRLTKGEQGGLTLEDKAHFIQRQLVETRQITK NVAGILDQRYNAKSKEKKVQIITLKASLTSQFRSIFGLYKVREVNDYHHGQDAYLNCVVATTLLKVYPNLAPEFVYGEYPK FQTFKENKATAKAIIYTNLLRFFTEDEPRFTKDGEILWSNSYLKTIKKELNYHQMNIVKKVEVQKGGFSKESIKPKGPSNK LIPVKNGLDPQKYGGFDSPVVAYTVLFTHEKGKKPLIKQEILGITIMEKTRFEQNPILFLEEKGFLRPRVLMKLPKYTLYE FPEGRRRLLASAKEAQKGNQMVLPEHLLTLLYHAKQCLLPNQSESLAYVEQHQPEFQEILERVVDFAEVHTLAKSKVQQIV KLFEANQTADVKEIAASFIQLMQFNAMGAPSTFKFFQKDIERARYTSIKEIFDATIIYQSPTGLYETRRKVVD (SEQ ID NO: 46) |
| *Staphylococcus aureus* Cas9 | KRNYILGLDIGITSVGYGIIDYETRDVIDAGVRLFKEANVENNEGRRSKRGARRLKRRRRHRIQRVKKLLFDYNLLTDHSE LSGINPYEARVKGLSQKLSEEEFSAALLHLAKRRGVHNVNEVEEDTGNELSTKEQISRNSKALEEKYVAELQLERLKKDGE VRGSINRFKTSDYVKEAKQLLKVQKAYHQLDQSFIDTYIDLLETRRTYYEGPGEGSPFGWKDIKEWYEMLMGHCTYFPEEL RSVKYAYNADLYNALNDLNNLVITRDENEKLEYYEKFQIIENVFKQKKKPTLKQIAKEILVNEEDIKGYRVTSTGKPEFTN LKVYHDIKDITARKEIIENAELLDQIAKILTIYQSSEDIQEELTNLNSELTQEEIEQISNLKGYTGTHNLSLKAINLILDE LWHTNDNQIAIFNRLKLVPKKVDLSQQKEIPTTLVDDFILSPVVKRSFIQSIKVINAIIKKYGLPNDIIIELAREKNSKDA QKMINEMQKRNRQTNERIEEIIRTTGKENAKYLIEKIKLHDMQEGKCLYSLEAIPLEDLLNNPFNYEVDHIIPRSVSEDNS FNNKVLVKQEENSKKGNRTPFQYLSSSDSKISYETFKKHILNLAKGKGRISKTKKEYLLEERDINRFSVQKDFINRNLVDT RYATRGLMNLLRSYFRVNNLDVKVKSINGGFTSFLRRKWKFKKERNKGYKHHAEDALIIANADFIFKEWKKLDKAKKVMEN QMFEEKQAESMPEIETEQEYKEIFITPHQIKHIKDFKDYKYSHRVDKKPNRELINDTLYSTRKDDKGNTLIVNNLNGLYDK DNDKLKKLINKSPEKLLMYHHDPQTYQKLKLIMEQYGDEKNPLYKYYEETGNYLTKYSKKDNGPVIKKIKYYGNKLNAHLD ITDDYPNSRNKVVKLSLKPYRFDVYLDNGVYKFVTVKNLDVIKKENYYEVNSKCYEEAKKLKKISNQAEFIASFYNNDLIK INGELYRVIGVNNDLLNRIEVNMIDITYREYLENMNDKRPPRIIKTIASKTQSIKKYSTDILGNLYEVKSKKHPQIIKKG (SEQ ID NO: 47) |
| *Geobacillus thermodenitri-ficans* Cas9 | MKYKIGLDIGITSIGWAVINLDIPRIEDLGVRIFDRAENPKTGESLALPRRLARSARRRLRRRKHRLERIRRLFVREGILT KEELNKLFEKKHEIDVWQLRVEALDRKLNNDELARILLHLAKRRGFRSNRKSERTNKENSTMLKHIEENQSILSSYRTVAE MVVKDPKFSLHKRNKEDNYTNTVARDDLEREIKLIFAKQREYGNIVCTEAFEHEYISIWASQRPFASKDDIEKKVGFCTFE PKEKRAPKATYTFQSFTVWEHINKLRLVSPGGIRALTDDERRLIYKQAFHKNKITFHDVRTLLNLPDDTRFKGLLYDRNTT LKENEKVRFLELGAYHKIRKAIDSVYGKGAAKSFRPIDFDTFGYALTMFKDDTDIRSYLRNEYEQNGKRMENLADKVYDEE LIEELLNLSFSKFGHLSLKALRNILPYMEQGEVYSTACERAGYTFTGPKKKQKTVLLPNIPPIANPVVMRALTQARKVVNA IIKKYGSPVSIHIELARELSQSFDERRKMQKEQEGNRKKNETAIRQLVEYGLTLNPTGLDIVKFKLWSEQNGKCAYSLQPI EIERLLEPGYTEVDHVIPYSRSLDDSYTNKVLVLTKENREKGNRTPAEYLGLGSERWQQFETFVLINKQFSKKKRDRLLRL HYDENEENEFKNRNLNDTRYISRFLANFIREHLKFADSDDKQKVYTVNGRITAHLRSRWNENKNREESNLHHAVDAAIVAC TTPSDIARVTAFYQRREQNKELSKKTDPQFPQPWPHFADELQARLSKNPKESIKALNLGNYDNEKLESLQPVFVSRMPKRS ITGAAHQETLRRYIGIDERSGKIQTVVKKKLSEIQLDKTGHFPMYGKESDPRTYEAIRQRLLEHNNDPKKAFQEPLYKPKK NGELGPIIRTIKIIDTTNQVIPLNDGKTVAYNSNIVRVDVFEKDGKYYCVPIYTIDMMKGILPNKAIEPNKPYSEWKEMTE DYTFRFSLYPNDLIRIEFPREKTIKTAVGEEIKIKDLFAYYQTIDSSNGGLSLVSHDNNFSLRSIGSRTLKRFEKYQVDVL GNIYKVRGEKRVGVASSSHSKAGETIRPL (SEQ ID NO: 48) |
| ScCas9 *S. canis* 1375 AA 159.2 kDa | MEKKYSIGLDIGTNSVGWAVITDDYKVPSKKFKVLGNTNRKSIKKNLMGALLFDSGETAEATRLKRTARRRYTRRKNRIRY LQEIFANEMAKLDDSFFQRLEESFLVEEDKKNERHPIFGNLADEVAYHRNYPTIYHLRKKLADSPEKADLRLIYLALAHII KFRGHFLIEGKLNAENSDVAKLFYQLIQTYNQLFEESPLDEIEVDAKGILSARLSKSKRLEKLIAVFPNEKKNGLFGNIIA LALGLTPNFKSNFDLTEDAKLQLSKDTYDDDLDELLGQIGDQYADLFSAAKNLSDAILLSDILRSNSEVTKAPLSASMVKR YDEHHQDLALLKTLVRQQFPEKYAEIFKDDTKNGYAGYVGIGIKHRKRTTKLATQEEFYKFIKPILEKMDGAEELLAKLNR DDLLRKQRTFDNGSIPHQIHLKELHAILRRQEEFYPFLKENREKIEKILTFRIPYYVGPLARGNSRFAWLTRKSEEAITPW NFEEVVDKGASAQSFIERMTNFDEQLPNKKVLPKHSLLYEYFTVYNELTKVKYVTERMRKPEFLSGEQKKAIVDLLFKTNR KVTVKQLKEDYFKKIECFDSVEIIGVEDRFNASLGTYHDLLKIIKDKDFLDNEENEDILEDIVLTLTLFEDREMIEERLKT YAHLFDDKVMKQLKRRHYTGWGRLSRKMINGIRDKQSGKTILDFLKSDGFSNRNFMQLIHDDSLTFKEEIEKAQVSGQGDS LHEQIADLAGSPAIKKGILQTVKIVDELVKVMGHKPENIVIEMARENQTTTKGLQQSRERKKRIEEGIKELESQILKENPV ENTQLQNEKLYLYYLQNGRDMYVDQELDINRLSDYDVDHIVPQSFIKDDSIDNKVLTRSVENRGKSDNVPSEEVVKKMKNY WRQLLNAKLITQRKFDNLTKAERGGLSEADKAGFIKRQLVETRQITKHVARILDSRMNTKRDKNDKPIREVKVITLKSKLV SDFRKDFQLYKVRDINNYHHAHDAYLNAVVGTALIKKYPKLESEFVYGDYKVYDVRKMIAKSEQEIGKATAKRFFYSNIMN FFKTEVKLANGEIRKRPLIETNGETGEVVWNKEKDFATVRKVLAMPQVNIVKKTEVQTGGFSKESILSKRESAKLIPRKKG WDTRKYGGFGSPTVAYSILVVAKVEKGKAKKLKSVKVLVGITIMEKGSYEKDPIGFLEAKGYKDIKKELIFKLPKYSLFEL ENGRRRMLASATELQKANELVLPQHLVRLLYYTQNISATTGSNNLGYIEQHREEFKEIFEKIIDFSEKYILKNKVNSNLKS SFDEQFAVSDSILLSNSFVSLLKYTSFGASGGFTFLDLDVKQGRLRYQTVTEVLDATLIYQSITGLYETRTDLSQLGGD (SEQ ID NO: 49) |

The base editors described herein may include any of the above Cas9 ortholog sequences, or any variants thereof having at least 80%, at least 85%, at least 90%, at least 95%, or at least 99% sequence identity thereto.

The napDNAbp may include any suitable homologs and/or orthologs or naturally occurring enzymes, such as, Cas9. Cas9 homologs and/or orthologs have been described in various species, including, but not limited to, *S. pyogenes* and *S, thermophilus*. Preferably, the Cas moiety is configured (e.g. mutagenized, recombinantly engineered, or otherwise obtained from nature) as a nickase, i.e., capable of cleaving only a single strand of the target doubpdditional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5. 726-737; the entire contents of which are incorporated herein by reference. In some embodiments, a Cas9 nuclease has an inactive (e.g., an inactivated) DNA cleavage domain, that is, the Cas9 is a nickase. In some embodiments, the Cas9 protein comprises an amino acid sequence that is at least 80% identical to the amino acid sequence of a Cas9 protein as provided by any one of the variants of Table 3. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the Cas9 orthologs in the above tables.

(3) Dead Cas9 Variant

In certain embodiments, the base editors described herein may include a dead Cas9, e.g., dead SpCas9, which has no nuclease activity due to one or more mutations that inactive both nuclease domains of Cas9, namely the RuvC domain (which cleaves the non-protospacer DNA strand) and HNH domain (which cleaves the protospacer DNA strand). The nuclease inactivation may be due to one or mutations that result in one or more substitutions and/or deletions in the amino acid sequence of the encoded protein, or any variants thereof having at least 80%, at least 85%, at least 90%, at least 95%, or at least 99% sequence identity thereto.

As used herein, the term “dCas9” refers to a nuclease-inactive Cas9 or nuclease-dead Cas9, or a functional fragment thereof, and embraces any naturally occurring dCas9 from any organism, any naturally-occurring dCas9 equivalent or functional fragment thereof, any dCas9 homolog, ortholog, or paralog from any organism, and any mutant or variant of a dCas9, naturally-occurring or engineered. The term dCas9 is not meant to be particularly limiting and may be referred to as a “dCas9 or equivalent.” Exemplary dCas9 proteins and method for making dCas9 proteins are further described herein and/or are described in the art and are incorporated herein by reference.

In other embodiments, dCas9 corresponds to, or comprises in part or in whole, a Cas9 amino acid sequence having one or more mutations that inactivate the Cas9 nuclease activity. In other embodiments, Cas9 variants having mutations other than D10A and H840A are provided which may result in the full or partial inactivate of the endogneous Cas9 nuclease activity (e.g., nCas9 or dCas9, respectively). Such mutations, by way of example, include other amino acid substitutions at D10 and H820, or other substitutions within the nuclease domains of Cas9 (e.g., substitutions in the HNH nuclease subdomain and/or the RuvC1 subdomain) with reference to a wild type sequence such as Cas9 from *Streptococcus pyogenes* (NCBI Reference Sequence: NC_017053.1). In some embodiments, variants or homologues of Cas9 (e.g., variants of Cas9 from *Streptococcus pyogenes* (NCBI Reference Sequence: NC_017053.1)) are provided which are at least about 70% identical, at least about 80% identical, at least about 90% identical, at least about 95% identical, at least about 98% identical, at least about 99% identical, at least about 99.5% identical, or at least about 99.9% identical to NCBI Reference Sequence: NC_017053.1. In some embodiments, variants of dCas9 (e.g., variants of NCBI Reference Sequence: NC_017053.1) are, provided having amino acid sequences which are shorter, or longer than NC_017053.1 by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In one embodiment, the dead Cas9 may be based on the canonical SpCas9 sequence of Q99ZW2 and may have the following sequence, which comprises a D10A and an H8A substitutions (underlined and bolded), or a variant be variant of SEQ ID NO: 27 having at least 80%, at least 85%, at least 90%, at least 95%, or at least 99% sequence identity thereto:

| Description | Sequence | SEQ ID NO: |
|---|---|---|
| dead Cas9 or dCas9 *Streptococcus pyogenes* Q99ZW2 Cas9 with D10**X** and H810**X** Where "X" is any amino acid | MDKKYSIGL**X**IGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLILLKALVRQQLPEKYKEIFFDQSKNGYAGYIDGG<br>ASQEEFYKFIKPILEKMDGTEELLVKLNREDLLRKQRTEDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRENASLGTYHDLLKIIKDKDELDNE<br>ENEDILEDIVLTLILFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVD**X**IVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>LDATLIHQSITGLYETRIDLSQLGGD | 50 |
| dead Cas9 or dCas9 Streptococcus pyogenes Q99ZW2 Cas9 with D10**A** and H810**A** | MDKKYSIGL**A**IGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKERGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTEDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDELDNE | 51 |

-continued

| Description | Sequence | SEQ ID NO: |
|---|---|---|
| | ENEDILEDIVLTLILFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVD**A**IVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>ILDATLIHQSITGLYETRIDLSQLGGD | |

(4) Cas9 Nickase Variant

In one embodiment, the base editors described herein comprise a Cas9 nickase. The term "Cas9 nickase" of "nCas9" refers to a variant of Cas9 which is capable of introducing a single-strand break in a double strand DNA molecule target. In some embodiments, the Cas9 nickase comprises only a single functioning nuclease domain. The wild type Cas9 (e.g., the canonical SpCas9) comprises two separate nuclease domains, namely, the RuvC domain (which cleaves the non-protospacer DNA strand) and HNH domain (which cleaves the protospacer DNA strand). In one embodiment, the Cas9 nickase comprises a mutation in the RuvC domain which inactivates the RuvC nuclease activity. For example, mutations in aspartate (D) 10, histidine (H) 983, aspartate (D) 986, or glutamate (E) 762, have been reported as loss-of-function mutations of the RuvC nuclease domain and the creation of a functional Cas9 nickase (e.g., Nishimasu et al., "Crystal structure of Cas9 in complex with guide RNA and target DNA," Cell 156(5), 935-949, which is incorporated herein by reference). Thus, nickase mutations in the RuvC domain could include D10X, H983X, D986X, or E762X, wherein X is any amino acid other than the wild type amino acid. In certain embodiments, the nickase could be D10A, of H983A, or D986A, or E762A, or a combination thereof.

In various embodiments, the Cas9 nickase can having a mutation in the RuvC nuclease domain and have one of the following amino acid sequences, or a variant thereof having an amino acid sequence that has at least 80%, at least 85%, at least 90%, at least 95%, or at least 99% sequence identity thereto.

| Description | Sequence | SEQ ID NO: |
|---|---|---|
| Cas9 nickase *Streptococcus pyogenes* Q99ZW2 Cas9 with D10**X**, wherein X is any alternate amino acid | MDKKYSIGL**X**IGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKERGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTILLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDELDNE<br>ENEDILEDIVLTLILFEDREMIEERLKTYAHLEDDKVMKQLKRRRYTGWGRLSRKLINGIR<br>DKQSGKTILDFLKSDGFANRNEMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKEDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIEINGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYEDTTIDRKRYTSTKEV<br>LDATLIHQSITGLYETRIDLSQLGGD | 52 |
| Cas9 nickase *Streptococcus pyogenes* Q99ZW2 Cas9 with E762X, wherein X is any alternate amino acid | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESELVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLILLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRENASLGTYHDLLKIIKDKDELDNE<br>ENEDILEDIVLTLTLFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA | 53 |

-continued

| Description | Sequence | SEQ ID NO: |
|---|---|---|
| | IKKGILQTVKVVDELVKVMGRHKPENIVI**X**MARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKEDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>LDATLIHQSITGLYETRIDLSQLGGD | |
| Cas9 nickase *Streptococcus pyogenes* Q99ZW2 Cas9 with H983X, wherein X is any alternate amino acid | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDFLDNE<br>ENEDILEDIVLTLTLFEDREMIEERLKTYAHLFDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYH**X**AHDAYLNAVVGTALIKKYPKLESEFVYGDYKVYDVRKMIAKSEQEIGKATAKYF<br>FYSNIMNFFKTEITLANGEIRKRPLIEINGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLTNLGAPAAFKYFDTTIDRKRYTSTKEV<br>LDATLIHQSITGLYETRIDLSQLGGD | 54 |
| Cas9 nickase *Streptococcus pyogenes* Q99ZW2 Cas9 with D986X, wherein X is any alternate amino acid | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDFLDNE<br>ENEDILEDIVLTLTLFEDREMIEERLKTYAHLFDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAH**X**AYLNAVVGTALIKKYPKLESEFVYGDYKVYDVRKMIAKSEQEIGKATAKYF<br>FYSNIMNFFKTEITLANGEIRKRPLIEINGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>LDATLIHQSITGLYETRIDLSQLGGD | 55 |
| Cas9 nickase *Streptococcus pyogenes* Q99ZW2 Cas9 with D10**A** | MDKKYSIGL**A**IGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDFLDNE<br>ENEDILEDIVLTLTLFEDREMIEERLKTYAHLFDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG | 56 |

-continued

| Description | Sequence | SEQ ID NO: |
|---|---|---|
| | FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIEINGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>LDATLIHQSITGLYETRIDLSQLGGD | |
| Cas9 nickase *Streptococcus pyogenes* Q99ZW2 Cas9 with E762A | MDKKYSIGLDIGTNSVGWAVITDEYKVPSKKFKVLGNTDRHSIKKNLIGALLEDSGETAEA<br>TRLKRTARRRYTRRKNRICYLQEIFSNEMAKVDDSFFHRLEESELVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLEGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRENASLGTYHDLLKIIKDKDFLDNE<br>ENEDILEDIVLTLTLFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIAMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYEDTTIDRKRYTSTKEV<br>LDATLIHQSITGLYETRIDLSQLGGD | 57 |
| Cas9 nickase *Streptococcus pyogenes* Q99ZW2 Cas9 with H983A | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLILLKALVRQQLPEKYKEIFFDQSKNGYAGYIDGG<br>ASQEEFYKFIKPILEKMDGTEELLVKLNREDLLRKQRTEDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDELDNE<br>ENEDILEDIVLILILFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHAAHDAYLNAVVGTALIKKYPKLESEFVYGDYKVYDVRKMIAKSEQEIGKATAKYF<br>FYSNIMNFFKTEITLANGEIRKRPLIEINGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLTNLGAPAAFKYFDTTIDRKRYTSTKEV<br>LDATLIHQSITGLYETRIDLSQLGGD | 58 |
| Cas9 nickase *Streptococcus pyogenes* Q99ZW2 Cas9 with D986A | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKERGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDELDNE<br>ENEDILEDIVLTLILFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKNRGKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAHAAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT | 59 |

-continued

| Description | Sequence | SEQ ID NO: |
|---|---|---|
| | EVQTGGFSKESILPKRNSDKLIARKKDWDPKKYGGFDSPTVAYSVLVVAKVEKGKSKKLKS VKELLGITIMERSSFEKNPIDFLEAKGYKEVKKDLIIKLPKYSLFELENGRKRMLASAGEL QKGNELALPSKYVNFLYLASHYEKLKGSPEDNEQKQLFVEQHKHYLDEIIEQISEFSKRVI LADANLDKVLSAYNKHRDKPIREQAENIIHLFTLINLGAPAAFKYFDTTIDRKRYTSTKEV LDATLIHQSITGLYETRIDLSQLGGD | |

In another embodiment, the Cas9 nickase comprises a mutation in the HNH domain which inactivates the HNH nuclease activity. For example, mutations in histidine (H) 840 or asparagine (R) 863 have been reported as loss-of-function mutations of the HNH nuclease domain and the creation of a functional Cas9 nickase (e.g., Nishimasu et al., "Crystal structure of Cas9 in complex with guide RNA and target DNA," Cell 156(5), 935-949, which is incorporated herein by reference). Thus, nickase mutations in the HNH domain could include H840X and R863X, wherein X is any amino acid otherthan the wild type amino acid. In certain embodiments, the nickase could be H840A or R863A or a combination thereof.

In various embodiments, the Cas9 nickase can have a mutation in the HNH nuclease domain and have one of the following amino acid sequences, or a variant thereof having an amino acid sequence that has at least 80%, at least 85%, at least 90%, at least 95%, or at least 99% sequence identity thereto.

| Description | Sequence | SEQ ID NO: |
|---|---|---|
| Cas9 nickase *Streptococcus pyogenes* Q99ZW2 Cas9 with H840**X**, wherein X is any alternate amino acid | MDKKYSIGLDIGTNSVGWAVITDEYKVPSKKFKVLGNTDRHSIKKNLIGALLFDSGETAEA TRLKRTARRRYTRRKNRICYLQEIFSNEMAKVDDSFFHRLEESFLVEEDKKHERHPIFGNI VDEVAYHEKYPTIYHLRKKLVDSTDKADLRLIYLALAHMIKFRGHFLIEGDLNPDNSDVDK LFIQLVQTYNQLFEENPINASGVDAKAILSARLSKSRRLENLIAQLPGEKKNGLFGNLIAL SLGLTPNFKSNFDLAEDAKLQLSKDTYDDDLDNLLAQIGDQYADLFLAAKNLSDAILLSDI LRVNTEITKAPLSASMIKRYDEHHQDLILLKALVRQQLPEKYKEIFFDQSKNGYAGYIDGG ASQEEFYKFIKPILEKMDGTEELLVKLNREDLLRKQRTFDNGSIPHQIHLGELHAILRRQE DFYPFLKDNREKIEKILTFRIPYYVGPLARGNSRFAWMTRKSEETITPWNFEEVVDKGASA QSFIERMTNFDKNLPNEKVLPKHSLLYEYFTVYNELTKVKYVTEGMRKPAFLSGEQKKAIV DLLFKTNRKVTVKQLKEDYFKKIECFDSVEISGVEDRFNASLGTYHDLLKIIKDKDFLDNE ENEDILEDIVLILTLFEDREMIEERLKTYAHLEDDKVMKQLKRRRYTGWGRLSRKLINGIR DKQSGKTILDFLKSDGFANRNFMQLIHDDSLTFKEDIQKAQVSGQGDSLHEHIANLAGSPA IKKGILQTVKVVDELVKVMGRHKPENIVIEMARENQTTQKGQKNSRERMKRIEEGIKELGS QILKEHPVENTQLQNEKLYLYYLQNGRDMYVDQELDINRLSDYDVD**X**IVPQSFLKDDSIDN KVLTRSDKNRGKSDNVPSEEVVKKMKNYWRQLLNAKLITQRKFDNLTKAERGGLSELDKAG FIKRQLVETRQITKHVAQILDSRMNTKYDENDKLIREVKVITLKSKLVSDFRKDFQFYKVR EINNYHHAHDAYLNAVVGTALIKKYPKLESEFVYGDYKVYDVRKMIAKSEQEIGKATAKYF FYSNIMNFFKTEITLANGEIRKRPLIEINGETGEIVWDKGRDFATVRKVLSMPQVNIVKKT EVQTGGFSKESILPKRNSDKLIARKKDWDPKKYGGFDSPTVAYSVLVVAKVEKGKSKKLKS VKELLGITIMERSSFEKNPIDFLEAKGYKEVKKDLIIKLPKYSLFELENGRKRMLASAGEL QKGNELALPSKYVNFLYLASHYEKLKGSPEDNEQKQLFVEQHKHYLDEIIEQISEFSKRVI LADANLDKVLSAYNKHRDKPIREQAENIIHLFTLINLGAPAAFKYFDTTIDRKRYTSTKEV LDATLIHQSITGLYETRIDLSQLGGD | 60 |
| Cas9 nickase *Streptococcus pyogenes* Q99ZW2 Cas9 with H840**A**, wherein X is any alternate amino acid | MDKKYSIGLDIGTNSVGWAVITDEYKVPSKKFKVLGNTDRHSIKKNLIGALLFDSGETAEA TRLKRTARRRYTRRKNRICYLQEIFSNEMAKVDDSFFHRLEESFLVEEDKKHERHPIFGNI VDEVAYHEKYPTIYHLRKKLVDSTDKADLRLIYLALAHMIKFRGHFLIEGDLNPDNSDVDK LFIQLVQTYNQLFEENPINASGVDAKAILSARLSKSRRLENLIAQLPGEKKNGLFGNLIAL SLGLTPNFKSNFDLAEDAKLQLSKDTYDDDLDNLLAQIGDQYADLFLAAKNLSDAILLSDI LRVNTEITKAPLSASMIKRYDEHHQDLILLKALVRQQLPEKYKEIFFDQSKNGYAGYIDGG ASQEEFYKFIKPILEKMDGTEELLVKLNREDLLRKQRTFDNGSIPHQIHLGELHAILRRQE DFYPFLKDNREKIEKILTFRIPYYVGPLARGNSRFAWMTRKSEETITPWNFEEVVDKGASA QSFIERMTNFDKNLPNEKVLPKHSLLYEYFTVYNELTKVKYVTEGMRKPAFLSGEQKKAIV DLLFKTNRKVTVKQLKEDYFKKIECFDSVEISGVEDRFNASLGTYHDLLKIIKDKDFLDNE ENEDILEDIVLILILFEDREMIEERLKTYAHLEDDKVMKQLKRRRYTGWGRLSRKLINGIR DKQSGKTILDFLKSDGFANRNFMQLIHDDSLTFKEDIQKAQVSGQGDSLHEHIANLAGSPA IKKGILQTVKVVDELVKVMGRHKPENIVIEMARENQTTQKGQKNSRERMKRIEEGIKELGS QILKEHPVENTQLQNEKLYLYYLQNGRDMYVDQELDINRLSDYDVD**A**IVPQSFLKDDSIDN KVLTRSDKNRGKSDNVPSEEVVKKMKNYWRQLLNAKLITQRKFDNLTKAERGGLSELDKAG FIKRQLVETRQITKHVAQILDSRMNTKYDENDKLIREVKVITLKSKLVSDFRKDFQFYKVR EINNYHHAHDAYLNAVVGTALIKKYPKLESEFVYGDYKVYDVRKMIAKSEQEIGKATAKYF FYSNIMNFFKTEITLANGEIRKRPLIETNGETGEIVWDKGRDFATVRKVLSMPQVNIVKKT EVQTGGFSKESILPKRNSDKLIARKKDWDPKKYGGFDSPTVAYSVLVVAKVEKGKSKKLKS VKELLGITIMERSSFEKNPIDFLEAKGYKEVKKDLIIKLPKYSLFELENGRKRMLASAGEL QKGNELALPSKYVNFLYLASHYEKLKGSPEDNEQKQLFVEQHKHYLDEIIEQISEFSKRVI LADANLDKVLSAYNKHRDKPIREQAENIIHLFTLINLGAPAAFKYFDTTIDRKRYTSTKEV LDATLIHQSITGLYETRIDLSQLGGD | 61 |

-continued

| Description | Sequence | SEQ ID NO: |
|---|---|---|
| Cas9 nickase<br>*Streptococcus*<br>*pyogenes*<br>Q99ZW2 Cas9<br>with R863**X**,<br>wherein X is<br>any<br>alternate<br>amino acid | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDFLDNE<br>ENEDILEDIVLTLILFEDREMIEERLKTYAHLEDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKN**X**GKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLINLGAPAAFKYFDTTIDRKRYTSTKEV<br>LDATLIHQSITGLYETRIDLSQLGGD | 62 |
| Cas9 nickase<br>*Streptococcus*<br>*pyogenes*<br>Q99ZW2 Cas9<br>with R863**A**,<br>wherein X is<br>any<br>alternate<br>amino acid | MDKKYSIGLDIGTNSVGWAVITDEYKVPSKKFKVLGNTDRHSIKKNLIGALLFDSGETAEA<br>TRLKRTARRRYTRRKNRICYLQEIFSNEMAKVDDSFFHRLEESFLVEEDKKHERHPIFGNI<br>VDEVAYHEKYPTIYHLRKKLVDSTDKADLRLIYLALAHMIKFRGHFLIEGDLNPDNSDVDK<br>LFIQLVQTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDAILLSDI<br>LRVNTEITKAPLSASMIKRYDEHHQDLTLLKALVRQQLPEKYKEIFFDQSKNGYAGYIDGG<br>ASQEEFYKFIKPILEKMDGTEELLVKLNREDLLRKQRTFDNGSIPHQIHLGELHAILRRQE<br>DFYPFLKDNREKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPAFLSGEQKKAIV<br>DLLFKTNRKVTVKQLKEDYFKKIECFDSVEISGVEDRFNASLGTYHDLLKIIKDKDELDNE<br>ENEDILEDIVLTLILFEDREMIEERLKTYAHLFDDKVMKQLKRRRYTGWGRLSRKLINGIR<br>DKQSGKTILDFLKSDGFANRNFMQLIHDDSLTFKEDIQKAQVSGQGDSLHEHIANLAGSPA<br>IKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDN<br>KVLTRSDKN**A**GKSDNVPSEEVVKKMKNYWRQLLNAKLITQRKFDNLTKAERGGLSELDKAG<br>FIKRQLVETRQITKHVAQILDSRMNTKYDENDKLIREVKVITLKSKLVSDERKDFQFYKVR<br>EINNYHHAHDAYLNAVVGTALIKKYPKLESEFVYGDYKVYDVRKMIAKSEQEIGKATAKYF<br>FYSNIMNFFKTEITLANGEIRKRPLIETNGETGEIVWDKGRDFATVRKVLSMPQVNIVKKT<br>EVQTGGFSKESILPKRNSDKLIARKKDWDPKKYGGFDSPTVAYSVLVVAKVEKGKSKKLKS<br>VKELLGITIMERSSFEKNPIDFLEAKGYKEVKKDLIIKLPKYSLFELENGRKRMLASAGEL<br>QKGNELALPSKYVNFLYLASHYEKLKGSPEDNEQKQLFVEQHKHYLDEIIEQISEFSKRVI<br>LADANLDKVLSAYNKHRDKPIREQAENIIHLFTLTNLGAPAAFKYFDTTIDRKRYTSTKEV<br>LDATLIHQSITGLYETRIDLSQLGGD | 63 |

In some embodiments, the N-terminal methionine is removed from a Cas9 nickase, or from any Cas9 variant, ortholog, or equivalent disclosed or contemplated herein. For example, methionine-minus Cas9 nickases include the following sequences, or a variant thereof having an amino acid sequence that has at least 80%, at least 85%, at least 90%, at least 95%, or at least 99% sequence identity thereto.

| Description | Sequence |
|---|---|
| Cas9 nickase<br>(Met minus)<br>*Streptococcus*<br>*pyogenes*<br>Q99ZW2 Cas9<br>with H840**X**,<br>wherein X is<br>any<br>alternate<br>amino acid | DKKYSIGLDIGTNSVGWAVITDEYKVPSKKFKVLGNTDRHSIKKNLIGALLFDSGETAEATRLKRTARRRYT<br>RRKNRICYLQEIFSNEMAKVDDSFFHRLEESFLVEEDKKHERHPIFGNIVDEVAYHEKYPTIYHLRKKLVDS<br>TDKADLRLIYLALAHMIKFRGHFLIEGDLNPDNSDVDKLFIQLVQTYNQLFEENPINASGVDAKAILSARLS<br>KSRRLENLIAQLPGEKKNGLFGNLIALSLGLTPNFKSNFDLAEDAKLQLSKDTYDDDLDNLLAQIGDQYADL<br>FLAAKNLSDAILLSDILRVNTEITKAPLSASMIKRYDEHHQDLILLKALVRQQLPEKYKEIFFDQSKNGYAG<br>YIDGGASQEEFYKFIKPILEKMDGTEELLVKLNREDLLRKQRTFDNGSIPHQIHLGELHAILRRQEDFYPFL<br>KDNREKIEKILTFRIPYYVGPLARGNSRFAWMTRKSEETITPWNFEEVVDKGASAQSFIERMINEDKNLPNE<br>KVLPKHSLLYEYFTVYNELTKVKYVTEGMRKPAFLSGEQKKAIVDLLFKTNRKVTVKQLKEDYFKKIECFDS<br>VEISGVEDRFNASLGTYHDLLKIIKDKDELDNEENEDILEDIVLTLTLFEDREMIEERLKTYAHLEDDKVMK<br>QLKRRRYTGWGRLSRKLINGIRDKQSGKTILDELKSDGFANRNEMQLIHDDSLTFKEDIQKAQVSGQGDSLH<br>EHIANLAGSPAIKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVD**X**IVPQSFLKDDSIDNKVLIRSDKNRG |

-continued

| Description | Sequence |
|---|---|
| | KSDNVPSEEVVKKMKNYWRQLLNAKLITQRKFDNLTKAERGGLSELDKAGFIKRQLVETRQITKHVAQILDS<br>RMNTKYDENDKLIREVKVITLKSKLVSDFRKDFQFYKVREINNYHHAHDAYLNAVVGTALIKKYPKLESEFV<br>YGDYKVYDVRKMIAKSEQEIGKATAKYFFYSNIMNFFKTEITLANGEIRKRPLIEINGETGEIVWDKGRDFA<br>TVRKVLSMPQVNIVKKTEVQTGGFSKESILPKRNSDKLIARKKDWDPKKYGGFDSPTVAYSVLVVAKVEKGK<br>SKKLKSVKELLGITIMERSSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEIIEQISEFSKRVILADANLDKVLSAYNKH<br>RDKPIREQAENIIHLFTLTNLGAPAAFKYFDTTIDRKRYTSTKEVLDATLIHQSITGLYETRIDLSQLGGD<br>(SEQ ID NO: 64) |
| Cas9 nickase (Met minus) *Streptococcus pyogenes* Q99ZW2 Cas9 with H840**A**, wherein X is any alternate amino acid | DKKYSIGLDIGTNSVGWAVITDEYKVPSKKFKVLGNTDRHSIKKNLIGALLFDSGETAEATRLKRTARRRYT<br>RRKNRICYLQEIFSNEMAKVDDSFFHRLEESELVEEDKKHERHPIFGNIVDEVAYHEKYPTIYHLRKKLVDS<br>TDKADLRLIYLALAHMIKFRGHFLIEGDLNPDNSDVDKLFIQLVQTYNQLFEENPINASGVDAKAILSARLS<br>KSRRLENLIAQLPGEKKNGLFGNLIALSLGLIPNFKSNFDLAEDAKLQLSKDTYDDDLDNLLAQIGDQYADL<br>FLAAKNLSDAILLSDILRVNTEITKAPLSASMIKRYDEHHQDLILLKALVRQQLPEKYKEIFFDQSKNGYAG<br>YIDGGASQEEFYKFIKPILEKMDGTEELLVKLNREDLLRKQRTFDNGSIPHQIHLGELHAILRRQEDFYPEL<br>KDNREKIEKILTFRIPYYVGPLARGNSRFAWMTRKSEETITPWNFEEVVDKGASAQSFIERMTNFDKNLPNE<br>KVLPKHSLLYEYFTVYNELTKVKYVTEGMRKPAFLSGEQKKAIVDLLFKTNRKVTVKQLKEDYFKKIECFDS<br>VEISGVEDRFNASLGTYHDLLKIIKDKDELDNEENEDILEDIVLTLTLFEDREMIEERLKTYAHLFDDKVMK<br>QLKRRRYTGWGRLSRKLINGIRDKQSGKTILDFLKSDGFANRNFMQLIHDDSLTFKEDIQKAQVSGQGDSLH<br>EHIANLAGSPAIKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVD**A**IVPQSFLKDDSIDNKVLTRSDKNRG<br>KSDNVPSEEVVKKMKNYWRQLLNAKLITQRKFDNLTKAERGGLSELDKAGFIKRQLVETRQITKHVAQILDS<br>RMNTKYDENDKLIREVKVITLKSKLVSDFRKDFQFYKVREINNYHHAHDAYLNAVVGTALIKKYPKLESEFV<br>YGDYKVYDVRKMIAKSEQEIGKATAKYFFYSNIMNFFKTEITLANGEIRKRPLIETNGETGEIVWDKGRDFA<br>TVRKVLSMPQVNIVKKTEVQTGGFSKESILPKRNSDKLIARKKDWDPKKYGGFDSPTVAYSVLVVAKVEKGK<br>SKKLKSVKELLGITIMERSSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEIIEQISEFSKRVILADANLDKVLSAYNKH<br>RDKPIREQAENIIHLFTLINLGAPAAFKYFDTTIDRKRYTSTKEVLDATLIHQSITGLYETRIDLSQLGGD<br>(SEQ ID NO: 65) |
| Cas9 nickase (Met minus) *Streptococcus pyogenes* Q99ZW2 Cas9 with R863X, wherein X is any alternate amino acid | DKKYSIGLDIGTNSVGWAVITDEYKVPSKKFKVLGNTDRHSIKKNLIGALLFDSGETAEATRLKRTARRRYT<br>RRKNRICYLQEIFSNEMAKVDDSFFHRLEESELVEEDKKHERHPIFGNIVDEVAYHEKYPTIYHLRKKLVDS<br>TDKADLRLIYLALAHMIKFRGHFLIEGDLNPDNSDVDKLFIQLVQTYNQLFEENPINASGVDAKAILSARLS<br>KSRRLENLIAQLPGEKKNGLFGNLIALSLGLTPNFKSNFDLAEDAKLQLSKDTYDDDLDNLLAQIGDQYADL<br>FLAAKNLSDAILLSDILRVNTEITKAPLSASMIKRYDEHHQDLILLKALVRQQLPEKYKEIFFDQSKNGYAG<br>YIDGGASQEEFYKFIKPILEKMDGTEELLVKLNREDLLRKRTFDNGSIPHQIHLGELHAILRRQEDFYPFL<br>KDNREKIEKILTFRIPYYVGPLARGNSRFAWMTRKSEETITPWNFEEVVDKGASAQSFIERMINEDKNLPNE<br>KVLPKHSLLYEYFTVYNELTKVKYVTEGMRKPAFLSGEQKKAIVDLLFKTNRKVTVKQLKEDYFKKIECFDS<br>VEISGVEDRFNASLGTYHDLLKIIKDKDELDNEENEDILEDIVLTLTLFEDREMIEERLKTYAHLEDDKVMK<br>QLKRRRYTGWGRLSRKLINGIRDKQSGKTILDFLKSDGFANRNFMQLIHDDSLTFKEDIQKAQVSGQGDSLH<br>EHIANLAGSPAIKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDNKVLIRSDKN**X**G<br>KSDNVPSEEVVKKMKNYWRQLLNAKLITQRKFDNLTKAERGGLSELDKAGFIKRQLVETRQITKHVAQILDS<br>RMNTKYDENDKLIREVKVITLKSKLVSDFRKDFQFYKVREINNYHHAHDAYLNAVVGTALIKKYPKLESEFV<br>YGDYKVYDVRKMIAKSEQEIGKATAKYFFYSNIMNFFKTEITLANGEIRKRPLIEINGETGEIVWDKGRDFA<br>TVRKVLSMPQVNIVKKTEVQTGGFSKESILPKRNSDKLIARKKDWDPKKYGGFDSPTVAYSVLVVAKVEKGK<br>SKKLKSVKELLGITIMERSSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEIIEQISEFSKRVILADANLDKVLSAYNKH<br>RDKPIREQAENIIHLFTLINLGAPAAFKYFDTTIDRKRYTSTKEVLDATLIHQSITGLYETRIDLSQLGGD<br>(SEQ ID NO: 66) |
| Cas9 nickase (Met minus) *Streptococcus pyogenes* Q99ZW2 Cas9 with R863**A**, wherein X is any alternate amino acid | DKKYSIGLDIGTNSVGWAVITDEYKVPSKKFKVLGNTDRHSIKKNLIGALLFDSGETAEATRLKRTARRRYT<br>RRKNRICYLQEIFSNEMAKVDDSFFHRLEESFLVEEDKKHERHPIFGNIVDEVAYHEKYPTIYHLRKKLVDS<br>TDKADLRLIYLALAHMIKFRGHFLIEGDLNPDNSDVDKLFIQLVQTYNQLFEENPINASGVDAKAILSARLS<br>KSRRLENLIAQLPGEKKNGLFGNLIALSLGLTPNFKSNFDLAEDAKLQLSKDTYDDDLDNLLAQIGDQYADL<br>FLAAKNLSDAILLSDILRVNTEITKAPLSASMIKRYDEHHQDLILLKALVRQQLPEKYKEIFFDQSKNGYAG<br>YIDGGASQEEFYKFIKPILEKMDGTEELLVKLNREDLLRKQRTFDNGSIPHQIHLGELHAILRRQEDFYPFL<br>KDNREKIEKILTFRIPYYVGPLARGNSRFAWMTRKSEETITPWNFEEVVDKGASAQSFIERMINEDKNLPNE<br>KVLPKHSLLYEYFTVYNELTKVKYVTEGMRKPAFLSGEQKKAIVDLLFKTNRKVTVKQLKEDYFKKIECFDS<br>VEISGVEDRFNASLGTYHDLLKIIKDKDELDNEENEDILEDIVLTLTLFEDREMIEERLKTYAHLEDDKVMK<br>QLKRRRYTGWGRLSRKLINGIRDKQSGKTILDFLKSDGFANRNFMQLIHDDSLTFKEDIQKAQVSGQGDSLH<br>EHIANLAGSPAIKKGILQTVKVVDELVKVMGRHKPENIVIEMARENQTTQKGQKNSRERMKRIEEGIKELGS<br>QILKEHPVENTQLQNEKLYLYYLQNGRDMYVDQELDINRLSDYDVDHIVPQSFLKDDSIDNKVLIRSDKN**A**G<br>KSDNVPSEEVVKKMKNYWRQLLNAKLITQRKFDNLTKAERGGLSELDKAGFIKRQLVETRQITKHVAQILDS<br>RMNTKYDENDKLIREVKVITLKSKLVSDFRKDFQFYKVREINNYHHAHDAYLNAVVGTALIKKYPKLESEFV<br>YGDYKVYDVRKMIAKSEQEIGKATAKYFFYSNIMNFFKTEITLANGEIRKRPLIEINGETGEIVWDKGRDFA<br>TVRKVLSMPQVNIVKKTEVQTGGFSKESILPKRNSDKLIARKKDWDPKKYGGFDSPTVAYSVLVVAKVEKGK<br>SKKLKSVKELLGITIMERSSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEIIEQISEFSKRVILADANLDKVLSAYNKH<br>RDKPIREQAENIIHLFTLINLGAPAAFKYFDTTIDRKRYTSTKEVLDATLIHQSITGLYETRIDLSQLGGD<br>(SEQ ID NO: 67) |

(5) Other Cas9 Variants

Besides dead Cas9 and Cas9 nickase variants, the Cas9 proteins used herein may also include other "Cas9 variants" having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 protein, including any wild type Cas9, or mutant Cas9 (e.g., a dead Cas9 or Cas9 nickase), or fragment Cas9, or circular permutant Cas9, or other variant of Cas9 disclosed herein or known in the art. In some embodiments, a Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a reference Cas9. In some embodiments, the Cas9 variant comprises a fragment of a reference Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SEQ ID NO: 28).

In some embodiments, the disclosure also may utilize Cas9 fragments which retain their functionality and which are fragments of any herein disclosed Cas9 protein. In some embodiments, the Cas9 fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In various embodiments, the base editors disclosed herein may comprise one of the Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 variants.

(6) Small-Sized Cas9 Variants

In some embodiments, the base editors contemplated herein can include a Cas9 protein that is of smaller molecular weight than the canonical SpCas9 sequence. In some embodiments, the smaller-sized Cas9 variants may facilitate delivery to cells, e.g., by an expression vector, nanoparticle, or other means of delivery.

The canonical SpCas9 protein is 1368 amino acids in length and has a predicted molecular weight of 158 kilodaltons. The term "small-sized Cas9 variant", as used herein, refers to any Cas9 variant—naturally occurring, engineered, or otherwise—that is less than at least 1300 amino acids, or at least less than 1290 amino acids, or than less than 1280 amino acids, or less than 1270 amino acid, or less than 1260 amino acid, or less than 1250 amino acids, or less than 1240 amino acids, or less than 1230 amino acids, or less than 1220 amino acids, or less than 1210 amino acids, or less than 1200 amino acids, or less than 1190 amino acids, or less than 1180 amino acids, or less than 1170 amino acids, or less than 1160 amino acids, or less than 1150 amino acids, or less than 1140 amino acids, or less than 1130 amino acids, or less than 1120 amino acids, or less than 1110 amino acids, or less than 1100 amino acids, or less than 1050 amino acids, or less than 1000 amino acids, or less than 950 amino acids, or less than 900 amino acids, or less than 850 amino acids, or less than 800 amino acids, or less than 750 amino acids, or less than 700 amino acids, or less than 650 amino acids, or less than 600 amino acids, or less than 550 amino acids, or less than 500 amino acids, but at least larger than about 400 amino acids and retaining the required functions of the Cas9 protein.

In various embodiments, the base editors disclosed herein may comprise one of the small-sized Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference small-sized Cas9 protein.

| Description | Sequence | SEQ ID NO: |
|---|---|---|
| SaCas9<br>*Staphylococcus aureus*<br>1053 AA<br>123 kDa | MGKRNYILGLDIGITSVGYGIIDYETRDVIDAGVRLFKEANVENNEGRRSKRGARRLKRRRR<br>HRIQRVKKLLFDYNLLTDHSELSGINPYEARVKGLSQKLSEEEFSAALLHLAKRRGVHNVNE<br>VEEDTGNELSTKEQISRNSKALEEKYVAELQLERLKKDGEVRGSINRFKTSDYVKEAKQLLK<br>VQKAYHQLDQSFIDTYIDLLETRRTYYEGPGEGSPFGWKDIKEWYEMLMGHCTYFPEELRSV<br>KYAYNADLYNALNDLNNLVITRDENEKLEYYEKFQIIENVFKQKKKPTLKQIAKEILVNEED<br>IKGYRVTSTGKPEFTNLKVYHDIKDITARKEIIENAELLDQIAKILTIYQSSEDIQEELTNL<br>NSELTQEEIEQISNLKGYTGTHNLSLKAINLILDELWHINDNQIAIFNRLKLVPKKVDLSQQ<br>KEIPTTLVDDFILSPVVKRSFIQSIKVINAIIKKYGLPNDIIIELAREKNSKDAQKMINEMQ<br>KRNRQTNERIEEIIRTTGKENAKYLIEKIKLHDMQEGKCLYSLEAIPLEDLLNNPFNYEVDH<br>IIPRSVSFDNSFNNKVLVKQEENSKKGNRTPFQYLSSSDSKISYETFKKHILNLAKGKGRIS<br>KTKKEYLLEERDINRFSVQKDFINRNLVDTRYATRGLMNLLRSYFRVNNLDVKVKSINGGFT<br>SFLRRKWKFKKERNKGYKHHAEDALIIANADFIFKEWKKLDKAKKVMENQMFEEKQAESMPE<br>IETEQEYKEIFITPHQIKHIKDFKDYKYSHRVDKKPNRKLINDTLYSTRKDDKGNTLIVNNL<br>NGLYDKDNDKLKKLINKSPEKLLMYHHDPQTYQKLKLIMEQYGDEKNPLYKYYEETGNYLTK<br>YSKKDNGPVIKKIKYYGNKLNAHLDITDDYPNSRNKVVKLSLKPYRFDVYLDNGVYKFVTVK<br>NLDVIKKENYYEVNSKCYEEAKKLKKISNQAEFIASFYKNDLIKINGELYRVIGVNNDLLNR<br>IEVNMIDITYREYLENMNDKRPPHIIKTIASKTQSIKKYSTDILGNLYEVKSKKHPQIIKK | 68 |
| NmeCas9<br>*N. meningitidis*<br>1083 AA<br>124.5 kDa | MAAFKPNSINYILGLDIGIASVGWAMVEIDEEENPIRLIDLGVRVFERAEVPKTGDSLAMAR<br>RLARSVRRLTRRRAHRLLRTRRLLKREGVLQAANFDENGLIKSLPNTPWQLRAAALDRKLTP<br>LEWSAVLLHLIKHRGYLSQRKNEGETADKELGALLKGVAGNAHALQTGDFRTPAELALNKFE<br>KESGHIRNQRSDYSHTFSRKDLQAELILLFEKQKEFGNPHVSGGLKEGIETLLMTQRPALSG<br>DAVQKMLGHCTFEPAEPKAAKNTYTAERFIWLIKLNNLRILEQGSERPLTDTERATLMDEPY<br>RKSKLTYAQARKLLGLEDTAFFKGLRYGKDNAEASTLMEMKAYHAISRALEKEGLKDKKSPL<br>NLSPELQDEIGTAFSLFKTDEDITGRLKDRIQPEILEALLKHISFDKFVQISLKALRRIVPL<br>MEQGKRYDEACAEIYGDHYGKKNTEEKIYLPPIPADEIRNPVVLRALSQARKVINGVVRRYG | 69 |

-continued

| Description | Sequence | SEQ ID NO: |
|---|---|---|
| | SPARIHIETAREVGKSFKDRKEIEKRQEENRKDREKAAAKFREYFPNFVGEPKSKDILKLRL<br>YEQQHGKCLYSGKEINLGRLNEKGYVEIDAALPESRTWDDSFNNKVLVLGSENQNKGNQTPY<br>EYFNGKDNSREWQEFKARVETSRFPRSKKQRILLQKFDEDGFKERNLNDTRYVNRFLCQFVA<br>DRMRLTGKGKKRVFASNGQITNLLRGFWGLRKVRAENDRHHALDAVVVACSTVAMQQKITRF<br>VRYKEMNAFDGKTIDKETGEVLHQKTHFPQPWEFFAQEVMIRVFGKPDGKPEFEEADTLEKL<br>RTLLAEKLSSRPEAVHEYVTPLFVSRAPNRKMSGQGHMETVKSAKRLDEGVSVLRVPLTQLK<br>LKDLEKMVNREREPKLYEALKARLEAHKDDPAKAFAEPFYKYDKAGNRTQQVKAVRVEQVQK<br>TGVWVRNHNGIADNATMVRVDVFEKGDKYYLVPIYSWQVAKGILPDRAVVQGKDEEDWQLID<br>DSFNFKFSLHPNDLVEVITKKARMFGYFASCHRGTGNINIRIHDLDHKIGKNGILEGIGVKT<br>ALSFQKYQIDELGKEIRPCRLKKRPPVR | |
| CjCas9<br>*C. jejuni*<br>984 AA<br>114.9 kDa | MARILAFDIGISSIGWAFSENDELKDCGVRIFTKVENPKTGESLALPRRLARSARKRLARRK<br>ARLNHLKHLIANEFKLNYEDYQSFDESLAKAYKGSLISPYELRFRALNELLSKQDFARVILH<br>IAKRRGYDDIKNSDDKEKGAILKAIKQNEEKLANYQSVGEYLYKEYFQKFKENSKEFTNVRN<br>KKESYERCIAQSFLKDELKLIFKKQREFGFSFSKKFEEEVLSVAFYKRALKDFSHLVGNCSF<br>FTDEKRAPKNSPLAFMFVALTRIINLLNNLKNTEGILYTKDDLNALLNEVLKNGTLTYKQTK<br>KLLGLSDDYEFKGEKGTYFIEFKKYKEFIKALGEHNLSQDDLNEIAKDITLIKDEIKLKKAL<br>AKYDLNQNQIDSLSKLEFKDHLNISFKALKLVTPLMLEGKKYDEACNELNLKVAINEDKKDF<br>LPAFNETYYKDEVINPVVLRAIKEYRKVLNALLKKYGKVHKINIELAREVGKNHSQRAKIEK<br>EQNENYKAKKDAELECEKLGLKINSKNILKLRLFKEQKEFCAYSGEKIKISDLQDEKMLEID<br>HIYPYSRSFDDSYMNKVLVFTKQNQEKLNQTPFEAFGNDSAKWQKIEVLAKNLPTKKQKRIL<br>DKNYKDKEQKNFKDRNLNDTRYIARLVLNYTKDYLDFLPLSDDENTKLNDTQKGSKVHVEAK<br>SGMLTSALRHTWGFSAKDRNNHLHHAIDAVIIAYANNSIVKAFSDFKKEQESNSAELYAKKI<br>SELDYKNKRKFFEPFSGFRQKVLDKIDEIFVSKPERKKPSGALHEETFRKEEEFYQSYGGKE<br>GVLKALELGKIRKVNGKIVKNGDMFRVDIFKHKKINKFYAVPIYTMDFALKVLPNKAVARSK<br>KGEIKDWILMDENYEFCFSLYKDSLILIQTKDMQEPEFVYYNAFTSSTVSLIVSKHDNKFET<br>LSKNQKILFKNANEKEVIAKSIGIQNLKVFEKYIVSALGEVTKAEFRQREDFKK | 70 |
| GeoCas9<br>*G.*<br>*stearothermo-*<br>*philus*<br>1087 AA<br>127 kDa | MRYKIGLDIGITSVGWAVMNLDIPRIEDLGVRIFDRAENPQTGESLALPRRLARSARRRLRR<br>RKHRLERIRRLVIREGILTKEELDKLFEEKHEIDVWQLRVEALDRKLNNDELARVLLHLAKR<br>RGFKSNRKSERSNKENSTMLKHIEENRAILSSYRTVGEMIVKDPKFALHKRNKGENYTNTIA<br>RDDLEREIRLIFSKQREFGNMSCTEEFENEYITIWASQRPVASKDDIEKKVGFCTFEPKEKR<br>APKATYTFQSFIAWEHINKLRLISPSGARGLIDEERRLLYEQAFQKNKITYHDIRTLLHLPD<br>DTYFKGIVYDRGESRKQNENIRFLELDAYHQIRKAVDKVYGKGKSSSFLPIDEDTFGYALTL<br>FKDDADIHSYLRNEYEQNGKRMPNLANKVYDNELIEELLNLSFTKFGHLSLKALRSILPYME<br>QGEVYSSACERAGYTFTGPKKKQKTMLLPNIPPIANPVVMRALTQARKVVNAIIKKYGSPVS<br>IHIELARDLSQTFDERRKIKKEQDENRKKNETAIRQLMEYGLTLNPTGHDIVKFKLWSEQNG<br>RCAYSLQPIEIERLLEPGYVEVDHVIPYSRSLDDSYTNKVLVLTRENREKGNRIPAEYLGVG<br>TERWQQFETFVLINKQFSKKKRDRLLRLHYDENEETEFKNRNLNDTRYISRFFANFIREHLK<br>FAESDDKQKVYTVNGRVTAHLRSRWEFNKNREESDLHHAVDAVIVACTTPSDIAKVTAFYQR<br>REQNKELAKKTEPHFPQPWPHFADELRARLSKHPKESIKALNLGNYDDQKLESLQPVFVSRM<br>PKRSVTGAAHQETLRRYVGIDERSGKIQTVVKTKLSEIKLDASGHFPMYGKESDPRTYEAIR<br>QRLLEHNNDPKKAFQEPLYKPKKNGEPGPVIRTVKIIDTKNQVIPLNDGKTVAYNSNIVRVD<br>VFEKDGKYYCVPVYIMDIMKGILPNKAIEPNKPYSEWKEMTEDYTFRFSLYPNDLIRIELPR<br>EKTVKTAAGEEINVKDVFVYYKTIDSANGGLELISHDHRFSLRGVGSRTLKRFEKYQVDVLG<br>NIYKVRGEKRVGLASSAHSKPGKTIRPLQSTRD | 71 |
| LbaCas12a<br>*L. bacterium*<br>1228 AA<br>143.9 kDa | MSKLEKFTNCYSLSKTLRFKAIPVGKTQENIDNKRLLVEDEKRAEDYKGVKKLLDRYYLSFI<br>NDVLHSIKLKNLNNYISLFRKKTRTEKENKELENLEINLRKEIAKAFKGNEGYKSLFKKDII<br>ETILPEFLDDKDEIALVNSENGFTTAFTGFFDNRENMFSEEAKSISIAFRCINENLTRYISN<br>MDIFEKVDAIFDKHEVQEIKEKILNSDYDVEDFFEGEFFNFVLTQEGIDVYNAIIGGFVTES<br>GEKIKGLNEYINLYNQKTKQKLPKFKPLYKQVLSDRESLSFYGEGYTSDEEVLEVERNTLNK<br>NSEIFSSIKKLEKLFKNFDEYSSAGIFVKNGPAISTISKDIFGEWNVIRDKWNAEYDDIHLK<br>KKAVVTEKYEDDRRKSFKKIGSESLEQLQEYADADLSVVEKLKEIIIQKVDEIYKVYGSSEK<br>LFDADFVLEKSLKKNDAVVAIMKDLLDSVKSFENYIKAFFGEGKETNRDESFYGDFVLAYDI<br>LLKVDHIYDAIRNYVTQKPYSKDKFKLYFQNPQFMGGWDKDKETDYRATILRYGSKYYLAIM<br>DKKYAKCLQKIDKDDVNGNYEKINYKLLPGPNKMLPKVFFSKKWMAYYNPSEDIQKIYKNGT<br>FKKGDMFNLNDCHKLIDFFKDSISRYPKWSNAYDENFSETEKYKDIAGFYREVEEQGYKVSF<br>ESASKKEVDKLVEEGKLYMFQIYNKDFSDKSHGTPNLHTMYFKLLFDENNHGQIRLSGGAEL<br>FMRRASLKKEELVVHPANSPIANKNPDNPKKITTLSYDVYKDKRFSEDQYELHIPIAINKCP<br>KNIFKINTEVRVLLKHDDNPYVIGIDRGERNLLYIVVVDGKGNIVEQYSLNEIINNENGIRI<br>KTDYHSLLDKKEKERFEARQNWTSIENIKELKAGYISQVVHKICELVEKYDAVIALEDLNSG<br>FKNSRVKVEKQVYQKFEKMLIDKLNYMVDKKSNPCATGGALKGYQITNKFESFKSMSTQNGF<br>IFYIPAWLISKIDPSTGFVNLLKTKYTSIADSKKFISSFDRIMYVPEEDLFEFALDYKNFSR<br>TDADYIKKWKLYSYGNRIRIFRNPKKNNVEDWEEVCLTSAYKELFNKYGINYQQGDIRALLC<br>EQSDKAFYSSFMALMSLMLQMRNSITGRTDVDFLISPVKNSDGIFYDSRNYEAQENAILPKN<br>ADANGAYNIARKVLWAIGQFKKAEDEKLDKVKIAISNKEWLEYAQTSVKH | 72 |
| BhCas12b<br>*B. hisashii*<br>1108 AA<br>130.4 kDa | MATRSFILKIEPNEEVKKGLWKTHEVINHGIAYYMNILKLIRQEAIYEHHEQDPKNPKKVSK<br>AEIQAELWDFVLKMQKCNSFTHEVDKDEVENILRELYEELVPSSVEKKGEANQLSNKFLYPL<br>VDPNSQSGKGTASSGRKPRWYNIKIAGDPSWEEEKKKWEEDKKKDPLAKILGKLAEYGLIPL<br>FIPYTDSNEPIVKEIKWMEKSRNQSVRRLDKDMFIQALERFLSWESWNLKVKEEYEKVEKEY<br>KILEERIKEDIQALKALEQYEKERQEQLLRDILNINEYRLSKRGLRGWREIIQKWLKMDENE<br>PSEKYLEVFKDYQRKHPREAGDYSVYEFLSKKENHFIWRNHPEYPYLYATFCEIDKKKKDAK<br>QQATFTLADPINHPLWVRFEERSGSNLNKYRILTEQLHTEKLKKKLTVQLDRLIYPTESGGW | 73 |

-continued

| Description | Sequence | SEQ ID NO: |
|---|---|---|
| | EEKGKVDIVLLPSRQFYNQIFLDIEEKGKHAFTYKDESIKFPLKGTLGGARVQFDRDHLRRY PHKVESGNVGRIYFNMTVNIEPTESPVSKSLKIHRDDFPKVVNFKPKELTEWIKDSKGKKLK SGIESLEIGLRVMSIDLGQRQAAAASIFEVVDQKPDIEGKLFFPIKGTELYAVHRASENIKL PGETLVKSREVLRKAREDNLKLMNQKLNFLRNVLHFQQFEDITEREKRVTKWISRQENSDVP LVYQDELIQIRELMYKPYKDWVAFLKQLHKRLEVEIGKEVKHWRKSLSDGRKGLYGISLKNI DEIDRTRKFLLRWSLRPTEPGEVRRLEPGQRFAIDQLNHLNALKEDRLKKMANTIIMHALGY CYDVRKKKWQAKNPACQIILFEDLSNYNPYEERSRFENSKLMKWSRREIPRQVALQGEIYGL QVGEVGAQFSSRFHAKTGSPGIRCSVVTKEKLQDNRFFKNLQREGRLILDKIAVLKEGDLYP DKGGEKFISLSKDRKCVTTHADINAAQNLQKRFWIRTHGFYKVYCKAYQVDGQTVYIPESKD QKQKIIEEFGEGYFILKDGVYEWVNAGKLKIKKGSSKQSSSELVDSDILKDSFDLASELKGE KLMLYRDPSGNVFPSDKWMAAGVFFGKLERILISKLTNQYSISTIEDDSSKQSM | |

(7) Cas9 Equivalents

In some embodiments, the base editors described herein can include any Cas9 equivalent. As used herein, the term "Cas9 equivalent" is a broad term that encompasses any napDNAbp protein that serves the same function as Cas9 in the present base editors despite that its amino acid primary sequence and/or its three-dimensional structure may be different and/or unrelated from an evolutionary standpoint. Thus, while Cas9 equivalents include any Cas9 ortholog, homolog, mutant, or variant described or embraced herein that are evolutionarily related, the Cas9 equivalents also embrace proteins that may have evolved through convergent evolution processes to have the same or similar function as Cas9, but which do not necessarily have any similarity with regard to amino acid sequence and/or three dimensional structure. The base editors described here embrace any Cas9 equivalent that would provide the same or similar function as Cas9 despite that the Cas9 equivalent may be based on a protein that arose through convergent evolution.

For example, CasX is a Cas9 equivalent that reportedly has the same function as Cas9 but which evolved through convergent evolution. Thus, the CasX protein described in Liu et al., "CasX enzymes comprises a distinct family of RNA-guided genome editors," Nature, 2019, Vol. 566: 218-223, is contemplated to be used with the base editors described herein. In addition, any variant or modification of CasX is conceivable and within the scope of the present disclosure.

Cas9 is a bacterial enzyme that evolved in a wide variety of species. However, the Cas9 equivalents contemplated herein may also be obtained from archaea, which constitute a domain and kingdom of single-celled prokaryotic microbes different from bacteria.

In some embodiments. Cas9 equivalents may refer to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure. Also see Liu et al., "CasX enzymes comprises a distinct family of RNA-guided genome editors," *Nature,* 2019, Vol. 566: 218-223. Any of these Cas9 equivalents are contemplated.

In some embodiments, the Cas9 equivalent comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein.

In various embodiments, the nucleic acid programmable DNA binding proteins include, without limitation, Cas9 (e.g., dCas9 and nCas9), CasX, CasY, Cpf1. C2c1, C2c2, C2C3, Argonaute, Cas12a, and Cas12b. One example of a nucleic acid programmable DNA-binding protein that has different PAM specificity than Cas9 is Clustered Regularly Interspaced Short Palindromic Repeats from Prevotella and Francisella 1 (Cpf1). Similar to Cas9, Cpf1 is also a class 2 CRISPR effector. It has been shown that Cpf1 mediates robust DNA interference with features distinct from Cas9, Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference. The state of the art may also now refer to Cpf1 enzymes as Cas12a.

In still other embodiments, the Cas protein may include any CRISPR associated protein, including but not limited to, Cas12a, Cas12b, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof, and preferably comprising a nickase mutation (e.g., a mutation corresponding to the D10A mutation of the wild type Cas9 polypeptide of SEQ ID NO: 28).

In various other embodiments, the napDNAbp can be any of the following proteins: a Cas9, a Cpf1, a CasX, a CasY, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, a circularly permuted Cas9, or an Argonaute (Ago) domain, or a variant thereof.

Exemplary Cas9 equivalent protein sequences can include the following:

| Description | Sequence |
|---|---|
| AsCas12a (previously known as Cpf1) *Acidaminococcus* sp. (strain BV3L6) UniProtKB U2UMQ6 | MTQFEGFTNLYQVSKTLRFELIPQGKTLKHIQEQGFIEEDKARNDHYKELKPIIDRIYKTYADQCLQLVQLDW ENLSAAIDSYRKEKTEETRNALIEEQATYRNAIHDYFIGRTDNLTDAINKRHAEIYKGLFKAELFNGKVLKQL GTVTTTEHENALLRSFDKFTTYFSGFYENRKNVESAEDISTAIPHRIVQDNFPKFKENCHIFTRLITAVPSLR EHFENVKKAIGIFVSTSIEEVFSFPFYNQLLTQTQIDLYNQLLGGISREAGTEKIKGLNEVLNLAIQKNDETA HIIASLPHRFIPLFKQILSDRNTLSFILEEFKSDEEVIQSFCKYKILLRNENVLETAEALFNELNSIDLTHIF ISHKKLETISSALCDHWDTLRNALYERRISELTGKITKSAKEKVQRSLKHEDINLQEIISAAGKELSEAFKQK TSEILSHAHAALDQPLPTTLKKQEEKEILKSQLDSLLGLYHLLDWFAVDESNEVDPEFSARLIGIKLEMEPSL SFYNKARNYATKKPYSVEKFKLNFQMPTLASGWDVNKEKNNGAILFVKNGLYYLGIMPKQKGRYKALSFEPTE KTSEGFDKMYYDYFPDAAKMIPKCSTQLKAVTAHFQTHTTPILLSNNFIEPLEITKEIYDLNNPEKEPKKFQT AYAKKTGDQKGYREALCKWIDFTRDFLSKYTKITSIDLSSLRPSSQYKDLGEYYAELNPLLYHISFQRIAEKE IMDAVETGKLYLFQIYNKDFAKGHHGKPNLHTLYWTGLFSPENLAKTSIKLNGQAELFYRPKSRMKRMAHRLG EKMLNKKLKDQKTPIPDTLYQELYDYVNHRLSHDLSDEARALLPNVITKEVSHEIIKDRRFTSDKFFFHVPIT LNYQAANSPSKENQRVNAYLKEHPETPIIGIDRGERNLIYITVIDSTGKILEQRSLNTIQQFDYQKKLDNREK ERVAARQAWSVVGTIKDLKQGYLSQVIHEIVDLMIHYQAVVVLENLNFGFKSKRIGIAEKAVYQQFEKMLIDK LNCLVLKDYPAEKVGGVLNPYQLTDQFTSFAKMGTQSGFLFYVPAPYTSKIDPLIGFVDPFVWKTIKNHESRK HFLEGFDFLHYDVKTGDFILHFKMNRNLSFQRGLPGFMPAWDIVFEKNETQFDAKGTPFIAGKRIVPVIENHR FTGRYRDLYPANELIALLEEKGIVERDGSNILPKLLENDDSHAIDTMVALIRSVLQMRNSNAATGEDYINSPV RDLNGVCFDSRFQNPEWPMDADANGAYHIALKGQLLLNHLKESKDLKLQNGISNQDWLAYIQELRN (SEQ ID NO: 74) |
| AsCas12a nickase (e.g., R1226A) | MTQFEGFTNLYQVSKTLRFELIPQGKILKHIQEQGFIEEDKARNDHYKELKPIIDRIYKTYADQCLQLVQLDW ENLSAAIDSYRKEKTEETRNALIEEQATYRNAIHDYFIGRIDNLTDAINKRHAEIYKGLFKAELFNGKVLKQL GTVTTTEHENALLRSFDKFTTYFSGFYENRKNVESAEDISTAIPHRIVQDNFPKFKENCHIFTRLITAVPSLR EHFENVKKAIGIFVSTSIEEVFSFPFYNQLLTQTQIDLYNQLLGGISREAGTEKIKGLNEVLNLAIQKNDETA HIIASLPHRFIPLFKQILSDRNTLSFILEEFKSDEEVIQSFCKYKILLRNENVLETAEALFNELNSIDLTHIF ISHKKLETISSALCDHWDTLRNALYERRISELIGKITKSAKEKVQRSLKHEDINLQEIISAAGKELSEAFKQK TSEILSHAHAALDQPLPTTLKKQEEKEILKSQLDSLLGLYHLLDWFAVDESNEVDPEFSARLTGIKLEMEPSL SFYNKARNYATKKPYSVEKFKLNFQMPTLASGWDVNKEKNNGAILFVKNGLYYLGIMPKQKGRYKALSFEPTE KTSEGFDKMYYDYFPDAAKMIPKCSTQLKAVTAHFQTHTTPILLSNNFIEPLEITKEIYDLNNPEKEPKKFQT AYAKKTGDQKGYREALCKWIDFTRDELSKYTKITSIDLSSLRPSSQYKDLGEYYAELNPLLYHISFQRIAEKE IMDAVETGKLYLFQIYNKDFAKGHHGKPNLHTLYWTGLFSPENLAKTSIKLNGQAELFYRPKSRMKRMAHRLG EKMLNKKLKDQKTPIPDTLYQELYDYVNHRLSHDLSDEARALLPNVITKEVSHEIIKDRRFTSDKFFFHVPIT LNYQAANSPSKFNQRVNAYLKEHPETPIIGIDRGERNLIYITVIDSTGKILEQRSLNTIQQFDYQKKLDNREK ERVAARQAWSVVGTIKDLKQGYLSQVIHEIVDLMIHYQAVVVLENLNFGFKSKRIGIAEKAVYQQFEKMLIDK LNCLVLKDYPAEKVGGVLNPYQLTDQFTSFAKMGTQSGFLFYVPAPYTSKIDPLIGFVDPFVWKTIKNHESRK HFLEGFDFLHYDVKTGDFILHFKMNRNLSFQRGLPGEMPAWDIVFEKNETQFDAKGTPFIAGKRIVPVIENHR FTGRYRDLYPANELIALLEEKGIVERDGSNILPKLLENDDSHAIDTMVALIRSVLQMANSNAATGEDYINSPV RDLNGVCFDSRFQNPEWPMDADANGAYHIALKGQLLLNHLKESKDLKLQNGISNQDWLAYIQELRN (SEQ ID NO: 75) |
| LbCas12a (previously known as Cpf1) *Lachnospiraceae bacterium* GAM79 Ref Seq. WP_119623382.1 | MNYKTGLEDFIGKESLSKTLRNALIPTESTKIHMEEMGVIRDDELRAEKQQELKEIMDDYYRTFIEEKLGQIQ GIQWNSLFQKMEETMEDISVRKDLDKIQNEKRKEICCYFTSDKRFKDLFNAKLITDILPNFIKDNKEYTEEEK AEKEQTRVLFQRFATAFTNYFNQRRNNFSEDNISTAISFRIVNENSEIHLQNMRAFQRIEQQYPEEVCGMEEE YKDMLQEWQMKHIYSVDFYDRELTQPGIEYYNGICGKINEHMNQFCQKNRINKNDFRMKKLHKQILCKKSSYY EIPFRFESDQEVYDALNEFIKTMKKKEIIRRCVHLGQECDDYDLGKIYISSNKYEQISNALYGSWDTIRKCIK EEYMDALPGKGEKKEEKAEAAAKKEEYRSIADIDKIISLYGSEMDRTISAKKCITEICDMAGQISIDPLVCNS DIKLLQNKEKTTEIKTILDSFLHVYQWGQTFIVSDIIEKDSYFYSELEDVLEDFEGITTLYNHVRSYVTQKPY STVKFKLHFGSPTLANGWSQSKEYDNNAILLMRDQKFYLGIFNVRNKPDKQIIKGHEKEEKGDYKKMIYNLLP GPSKMLPKVFITSRSGQETYKPSKHILDGYNEKRHIKSSPKFDLGYCWDLIDYYKECIHKHPDWKNYDFHFSD TKDYEDISGFYREVEMQGYQIKWTYISADEIQKLDEKGQIFLFQIYNKDFSVHSTGKDNLHTMYLKNLFSEEN LKDIVLKLNGEAELFFRKASIKTPIVHKKGSVLVNRSYTQTVGNKEIRVSIPEEYYTEIYNYLNHIGKGKLSS EAQRYLDEGKIKSFTATKDIVKNYRYCCDHYFLHLPITINFKAKSDVAVNERTLAYIAKKEDIHIIGIDRGER NLLYISVVDVHGNIREQRSFNIVNGYDYQQKLKDREKSRDAARKNWEEIEKIKELKEGYLSMVIHYIAQLVVK YNAVVAMEDLNYGFKTGRFKVERQVYQKFETMLIEKLHYLVFKDREVCEEGGVLRGYQLTYIPESLKKVGKQC GFIFYVPAGYTSKIDPTTGFVNLFSFKNLTNRESRQDFVGKFDEIRYDRDKKMFEFSFDYNNYIKKGTILAST KWKVYTNGTRLKRIVVNGKYTSQSMEVELTDAMEKMLQRAGIEYHDGKDLKGQIVEKGIEAEIIDIFRLTVQM RNSRSESEDREYDRLISPVLNDKGEFFDTATADKILPQDADANGAYCIALKGLYEVKQIKENWKENEQFPRNK LVQDNKTWEDEMQKKRYL (SEQ ID NO: 76) |
| PcCas12a - previously known at Cpf1 *Prevotella copri* Ref Seq. WP_119227726.1 | MAKNFEDFKRLYSLSKTLRFEAKPIGATLDNIVKSGLLDEDEHRAASYVKVKKLIDEYHKVFIDRVLDDGCLP LENKGNNNSLAEYYESYVSRAQDEDAKKKFKEIQQNLRSVIAKKLTEDKAYANLFGNKLIESYKDKEDKKKII DSDLIQFINTAESTQLDSMSQDEAKELVKEFWGFVTYFYGFFDNRKNMYTAEEKSTGIAYRLVNENLPKFIDN IEAFNRAITRPEIQENMGVLYSDESEYLNVESIQEMFQLDYYNMLLTQKQIDVYNAIIGGKTDDEHDVKIKGI NEYINLYNQQHKDDKLPKLKALFKQILSDRNAISWLPEEFNSDQEVLNAIKDCYERLAENVLGDKVLKSLLGS LADYSLDGIFIRNDLQLTDISQKMFGNWGVIQNAIMQNIKRVAPARKHKESEEDYEKRIAGIFKKADSFSISY INDCLNEADPNNAYFVENYFATFGAVNTPTMQRENLFALVQNAYTEVAALLHSDYPTVKHLAQDKANVSKIKA LLDAIKSLQHFVKPLLGKGDESDKDERFYGELASLWAELDTVTPLYNMIRNYMTRKPYSQKKIKLNFENPQLL GGWDANKEKDYATIILRRNGLYYLAIMDKDSRKLLGKAMPSDGECYEKMVYKFFKDVTTMIPKCSTQLKDVQA YFKVNTDDYVLNSKAFNKPLTITKEVEDLNNVLYGKYKKFQKGYLTATGDNVGYTHAVNVWIKFCMDELNSYD STCIYDFSSLKPESYLSLDAFYQDANLLLYKLSFARASVSYINQLVEEGKMYLFQIYNKDFSEYSKGTPNMHT LYWKALFDERNLADVVYKLNGQAEMFYRKKSIENTHPTHPANHPILNKNKDNKKKESLFDYDLIKDRRYTVDK |

-continued

| Description | Sequence |
|---|---|
| | FMFHVPITMNFKSVGSENINQDVKAYLRHADDMHIIGIDRGERHLLYLVVIDLQGNIKEQYSLNEIVNEYNGN<br>TYHTNYHDLLDVREEERLKARQSWQTIENIKELKEGYLSQVIHKITQLMVRYHAIVVLEDLSKGEMRSRQKVE<br>KQVYQKFEKMLIDKLNYLVDKKTDVSTPGGLLNAYQLTCKSDSSQKLGKQSGELFYIPAWNTSKIDPVTGFVN<br>LLDTHSLNSKEKIKAFFSKFDAIRYNKDKKWFEFNLDYDKFGKKAEDTRIKWTLCTRGMRIDTERNKEKNSQW<br>DNQEVDLTTEMKSLLEHYYIDIHGNLKDAISAQTDKAFFTGLLHILKLTLQMRNSITGTETDYLVSPVADENG<br>IFYDSRSCGNQLPENADANGAYNIARKGLMLIEQIKNAEDLNNVKFDISNKAWINFAQQKPYKNG (SEQ ID<br>NO: 77) |
| ErCas12a -<br>previously<br>known at<br>Cpf1<br>*Eubacterium*<br>*rectale*<br>Ref Seq.<br>WP_119223642.1 | MFSAKLISDILPEFVIHNNNYSASEKEEKTQVIKLESRFATSFKDYFKNRANCESANDISSSSCHRIVNDNAE<br>IFFSNALVYRRIVKNLSNDDINKISGDMKDSLKEMSLEEIYSYEKYGEFITQEGISFYNDICGKVNLEMNLYC<br>QKNKENKNLYKLRKLHKQILCIADTSYEVPYKFESDEEVYQSVNGELDNISSKHIVERLRKIGENYNGYNLDK<br>IYIVSKFYESVSQKTYRDWETINTALEIHYNNILPGNGKSKADKVKKAVKNDLQKSITEINELVSNYKLCPDD<br>NIKAETYIHEISHILNNFEAQELKYNPEIHLVESELKASELKNVLDVIMNAFHWCSVFMTEELVDKDNNFYAE<br>LEEIYDEIYPVISLYNLVRNYVTQKPYSTKKIKLNFGIPTLADGWSKSKEYSNNAIILMRDNLYYLGIFNAKN<br>KPDKKIIEGNTSENKGDYKKMIYNLLPGPNKMIPKVFLSSKTGVETYKPSAYILEGYKQNKHLKSSKDEDITE<br>CHDLIDYFKNCIAIHPEWKNFGFDFSDTSTYEDISGFYREVELQGYKIDWTYISEKDIDLLQEKGQLYLFQIY<br>NKDFSKKSSGNDNLHTMYLKNLFSEENLKDIVLKLNGEAEIFFRKSSIKNPIIHKKGSILVNRTYEAEEKDQF<br>GNIQIVRKTIPENIYQELYKYFNDKSDKELSDEAAKLKNVVGHHEAATNIVKDYRYTYDKYFLHMPITINFKA<br>NKTSFINDRILQYIAKEKDLHVIGIDRGERNLIYVSVIDTCGNIVEQKSFNIVNGYDYQIKLKQQEGARQIAR<br>KEWKEIGKIKEIKEGYLSLVIHEISKMVIKYNAIIAMEDLSYGFKKGRFKVERQVYQKFETMLINKLNYLVEK<br>DISITENGGLLKGYQLTYIPDKLKNVGHQCGCIFYVPAAYTSKIDPTTGFVNIFKFKDLTVDAKREFIKKFDS<br>IRYDSDKNLFCFTFDYNNFITQNTVMSKSSWSVYTYGVRIKRRFVNGRFSNESDTIDITKDMEKTLEMTDINW<br>RDGHDLRQDIIDYEIVQHIFEIFKLTVQMRNSLSELEDRDYDRLISPVLNENNIFYDSAKAGDALPKDADANG<br>AYCIALKGLYEIKQITENWKEDGKFSRDKLKISNKDWEDFIQNKRYL (SEQ ID NO: 78) |
| CsCas12a -<br>previously<br>known at<br>Cpf1<br>*Clostridium*<br>*sp.*<br>AF34-10BH<br>Ref Seq:<br>WP_118538418.1 | MNYKTGLEDFIGKESLSKTLRNALIPTESTKIHMEEMGVIRDDELRAEKQQELKEIMDDYYRAFIEEKLGQIQ<br>GIQWNSLFQKMEETMEDISVRKDLDKIQNEKRKEICCYFTSDKRFKDLFNAKLITDILPNFIKDNKEYTEEEK<br>AEKEQTRVLFQRFATAFTNYFNQRRNNFSEDNISTAISFRIVNENSEIHLQNMRAFQRIEQQYPEEVCGMEEE<br>YKDMLQEWQMKHIYLVDFYDRVLTQPGIEYYNGICGKINEHMNQFCQKNRINKNDFRMKKLHKQILCKKSSYY<br>EIPFRFESDQEVYDALNEFIKIMKEKEIICRCVHLGQKCDDYDLGKIYISSNKYEQISNALYGSWDTIRKCIK<br>EEYMDALPGKGEKKEEKAEAAAKKEEYRSIADIDKIISLYGSEMDRTISAKKCITEICDMAGQISTDPLVCNS<br>DIKLLQNKEKTTEIKTILDSFLHVYQWGQTFIVSDIIEKDSYFYSELEDVLEDFEGITTLYNHVRSYVTQKPY<br>STVKFKLHFGSPTLANGWSQSKEYDNNAILLMRDQKFYLGIFNVRNKPDKQIIKGHEKEEKGDYKKMIYNLLP<br>GPSKMLPKVFITSRSGQETYKPSKHILDGYNEKRHIKSSPKFDLGYCWDLIDYYKECIHKHPDWKNYDFHFSD<br>TKDYEDISGFYREVEMQGYQIKWTYISADEIQKLDEKGQIFLFQIYNKDFSVHSTGKDNLHTMYLKNLFSEEN<br>LKDIVLKLNGEAELFFRKASIKTPVVHKKGSVLVNRSYTQTVGDKEIRVSIPEEYYTEIYNYLNHIGRGKLST<br>EAQRYLEERKIKSFTATKDIVKNYRYCCDHYFLHLPITINFKAKSDIAVNERTLAYIAKKEDIHIIGIDRGER<br>NLLYISVVDVHGNIREQRSFNIVNGYDYQQKLKDREKSRDAARKNWEEIEKIKELKEGYLSMVIHYIAQLVVK<br>YNAVVAMEDLNYGFKTGRFKVERQVYQKFETMLIEKLHYLVFKDREVCEEGGVLRGYQLTYIPESLKKVGKQC<br>GFIFYVPAGYTSKIDPTTGFVNLFSFKNLINRESRQDFVGKFDEIRYDRDKKMFEFSFDYNNYIKKGTMLAST<br>KWKVYINGTRLKRIVVNGKYTSQSMEVELTDAMEKMLQRAGIEYHDGKDLKGQIVEKGIEAEIIDIFRLTVQM<br>RNSRSESEDREYDRLISPVLNDKGEFFDTATADKTLPQDADANGAYCIALKGLYEVKQIKENWKENEQFPRNK<br>LVQDNKTWFDFMQKKRYL (SEQ ID NO: 79) |
| BhCas12b<br>*Bacillus*<br>*hisashii*<br>Ref Seq.<br>WP_095142515.1 | MATRSFILKIEPNEEVKKGLWKTHEVLNHGIAYYMNILKLIRQEAIYEHHEQDPKNPKKVSKAEIQAELWDFV<br>LKMQKCNSFTHEVDKDEVENILRELYEELVPSSVEKKGEANQLSNKFLYPLVDPNSQSGKGTASSGRKPRWYN<br>LKIAGDPSWEEEKKKWEEDKKKDPLAKILGKLAEYGLIPLFIPYTDSNEPIVKEIKWMEKSRNQSVRRLDKDM<br>FIQALERFLSWESWNLKVKEEYEKVEKEYKTLEERIKEDIQALKALEQYEKERQEQLLRDTLNTNEYRLSKRG<br>LRGWREIIQKWLKMDENEPSEKYLEVFKDYQRKHPREAGDYSVYEFLSKKENHFIWRNHPEYPYLYATFCEID<br>KKKKDAKQQATFTLADPINHPLWVRFEERSGSNLNKYRILTEQLHTEKLKKKLTVQLDRLIYPTESGGWEEKG<br>KVDIVLLPSRQFYNQIFLDIEEKGKHAFTYKDESIKFPLKGTLGGARVQFDRDHLRRYPHKVESGNVGRIYFN<br>MTVNIEPTESPVSKSLKIHRDDFPKVVNFKPKELTEWIKDSKGKKLKSGIESLEIGLRVMSIDLGQRQAAAAS<br>IFEVVDQKPDIEGKLFFPIKGTELYAVHRASFNIKLPGETLVKSREVLRKAREDNLKLMNQKLNFLRNVLHFQ<br>QFEDITEREKRVTKWISRQENSDVPLVYQDELIQIRELMYKPYKDWVAFLKQLHKRLEVEIGKEVKHWRKSLS<br>DGRKGLYGISLKNIDEIDRTRKELLRWSLRPTEPGEVRRLEPGQRFAIDQLNHLNALKEDRLKKMANTIIMHA<br>LGYCYDVRKKKWQAKNPACQIILFEDLSNYNPYEERSRFENSKLMKWSRREIPRQVALQGEIYGLQVGEVGAQ<br>FSSRFHAKTGSPGIRCSVVTKEKLQDNRFFKNLQREGRLILDKIAVLKEGDLYPDKGGEKFISLSKDRKCVTT<br>HADINAAQNLQKRFWIRTHGFYKVYCKAYQVDGQTVYIPESKDQKQKIIEEFGEGYFILKDGVYEWVNAGKLK<br>IKKGSSKQSSSELVDSDILKDSFDLASELKGEKLMLYRDPSGNVFPSDKWMAAGVFFGKLERILISKLINQYS<br>ISTIEDDSSKQSM (SEQ ID NO: 80) |
| ThCas12b<br>*Thermomonas*<br>*hydrothermalis*<br>Ref Seq.<br>WP_072754838 | MSEKTTQRAYTLRLNRASGECAVCQNNSCDCWHDALWATHKAVNRGAKAFGDWLLTLRGGLCHTLVEMEVPAK<br>GNNPPQRPTDQERRDRRVLLALSWLSVEDEHGAPKEFIVATGRDSADDRAKKVEEKLREILEKRDFQEHEIDA<br>WLQDCGPSLKAHIREDAVWVNRRALFDAAVERIKTLTWEEAWDFLEPFFGTQYFAGIGDGKDKDDAEGPARQG<br>EKAKDLVQKAGQWLSARFGIGTGADFMSMAEAYEKIAKWASQAQNGDNGKATIEKLACALRPSEPPTLDTVLK<br>CISGPGHKSATREYLKTLDKKSTVTQEDLNQLRKLADEDARNCRKKVGKKGKKPWADEVLKDVENSCELTYLQ<br>DNSPARHREFSVMLDHAARRVSMAHSWIKKAEQRRRQFESDAQKLKNLQERAPSAVEWLDRFCESRSMTTGAN<br>TGSGYRIRKRAIEGWSYVVQAWAEASCDTEDKRIAAARKVQADPEIEKFGDIQLFEALAADEAICVWRDQEGT<br>QNPSILIDYVTGKTAEHNQKRFKVPAYRHPDELRHPVFCDFGNSRWSIQFAIHKEIRDRDKGAKQDTRQLQNR<br>HGLKMRLWNGRSMTDVNLHWSSKRLTADLALDQNPNPNPTEVTRADRLGRAASSAFDHVKIKNVFNEKEWNGR<br>LQAPRAELDRIAKLEEQGKTEQAEKLRKRLRWYVSFSPCLSPSGPFIVYAGQHNIQPKRSGQYAPHAQANKGR<br>ARLAQLILSRLPDLRILSVDLGHRFAAACAVWETLSSDAFRREIQGLNVLAGGSGEGDLFLHVEMTGDDGKRR<br>TVVYRRIGPDQLLDNTPHPAPWARLDRQFLIKLQGEDEGVREASNEELWTVHKLEVEVGRTVPLIDRMVRSGF<br>GKTEKQKERLKKLRELGWISAMPNEPSAETDEKEGEIRSISRSVDELMSSALGTLRLALKRHGNRARIAFAMT<br>ADYKPMPGGQKYYFHEAKEASKNDDETKRRDNQIEFLQDALSLWHDLFSSPDWEDNEAKKLWQNHIATLPNYQ<br>TPEEISAELKRVERNKKRKENRDKLRTAAKALAENDQLRQHLHDTWKERWESDDQQWKERLRSLKDWIFPRGK<br>AEDNPSIRHVGGLSITRINTISGLYQILKAFKMRPEPDDLRKNIPQKGDDELENFNRRLLEARDRLREQRVKQ |

-continued

| Description | Sequence |
|---|---|
| | LASRIIEAALGVGRIKIPKNGKLPKRPRTTVDTPCHAVVIESLKTYRPDDLRTRRENRQLMQWSSAKVRKYLK EGCELYGLHFLEVPANYTSRQCSRTGLPGIRCDDVPTGDFLKAPWWRRAINTAREKNGGDAKDRFLVDLYDHL NNLQSKGEALPATVRVPRQGGNLFIAGAQLDDINKERRAIQADLNAAANIGLRALLDPDWRGRWWYVPCKDGT SEPALDRIEGSTAFNDVRSLPTGDNSSRRAPREIENLWRDPSGDSLESGTWSPTRAYWDTVQSRVIELLRRHA GLPTS (SEQ ID NO: 81) |
| LsCas12b *Laceyella sacchari* WP_132221894.1 | MSIRSFKLKLKTKSGVNAEQLRRGLWRTHQLINDGIAYYMNWLVLLRQEDLFIRNKETNEIEKRSKEEIQAVL LERVHKQQQRNQWSGEVDEQTLLQALRQLYEEIVPSVIGKSGNASLKARFFLGPLVDPNNKTTKDVSKSGPTP KWKKMKDAGDPNWVQEYEKYMAERQTLVRLEEMGLIPLFPMYTDEVGDIHWLPQASGYTRTWDRDMFQQAIER LLSWESWNRRVRERRAQFEKKTHDFASRFSESDVQWMNKLREYEAQQEKSLEENAFAPNEPYALTKKALRGWE RVYHSWMRLDSAASEEAYWQEVATCQTAMRGEFGDPAIYQFLAQKENHDIWRGYPERVIDFAELNHLQRELRR AKEDATFTLPDSVDHPLWVRYEAPGGTNIHGYDLVQDTKRNLTLILDKFILPDENGSWHEVKKVPFSLAKSKQ FHRQVWLQEEQKQKKREVVFYDYSTNLPHLGTLAGAKLQWDRNFLNKRTQQQIEETGEIGKVFFNISVDVRPA VEVKNGRLQNGLGKALTVLTHPDGTKIVTGWKAEQLEKWVGESGRVSSLGLDSLSEGLRVMSIDLGQRTSATV SVFEITKEAPDNPYKFFYQLEGTEMFAVHQRSFLLALPGENPPQKIKQMREIRWKERNRIKQQVDQLSAILRL HKKVNEDERIQAIDKLLQKVASWQLNEEIATAWNQALSQLYSKAKENDLQWNQAIKNAHHQLEPVVGKQISLW RKDLSTGRQGIAGLSLWSIEELEATKKLLTRWSKRSREPGVVKRIERFETFAKQIQHHINQVKENRLKQLANL IVMTALGYKYDQEQKKWIEVYPACQVVLFENLRSYRFSFERSRRENKKLMEWSHRSIPKLVQMQGELFGLQVA DVYAAYSSRYHGRTGAPGIRCHALTEADLRNETNIIHELIEAGFIKEEHRPYLQQGDLVPWSGGELFATLQKP YDNPRILTLHADINAAQNIQKRFWHPSMWFRVNCESVMEGEIVTYVPKNKTVHKKQGKTFRFVKVEGSDVYEW AKWSKNRNKNTFSSITERKPPSSMILFRDPSGTFFKEQEWVEQKTFWGKVQSMIQAYMKKTIVQRMEE (SEQ ID NO: 82) |
| DtCas12b *Dsulfonatronum thiodismutans* WP_031386437 | MVLGRKDDTAELRRALWTTHEHVNLAVAEVERVLLRCRGRSYWILDRRGDPVHVPESQVAEDALAMAREAQRR NGWPVVGEDEEILLALRYLYEQIVPSCLLDDLGKPLKGDAQKIGTNYAGPLFDSDTCRRDEGKDVACCGPFHE VAGKYLGALPEWATPISKQEFDGKDASHLRFKATGGDDAFFRVSIEKANAWYEDPANQDALKNKAYNKDDWKK EKDKGISSWAVKYIQKQLQLGQDPRTEVRRKLWLELGLLPLFIPVEDKIMVGNLWNRLAVRLALAHLLSWESW NHRAVQDQALARAKRDELAALFLGMEDGFAGLREYELRRNESIKQHAFEPVDRPYVVSGRALRSWTRVREEWL RHGDTQESRKNICNRLQDRLRGKFGDPDVFHWLAEDGQEALWKERDCVTSFSLLNDADGLLEKRKGYALMTFA DARLHPRWAMYEAPGGSNLRTYQIRKTENGLWADVVLLSPRNESAAVEEKTENVRLAPSGQLSNVSFDQIQKG SKMVGRCRYQSANQQFEGLLGGAEILFDRKRIANEQHGATDLASKPGHVWFKLTLDVRPQAPQGWLDGKGRPA LPPEAKHFKTALSNKSKFADQVRPGLRVLSVDLGVRSFAACSVFELVRGGPDQGTYFPAADGRTVDDPEKLWA KHERSFKITLPGENPSRKEEIARRAAMEELRSLNGDIRRLKAILRLSVLQEDDPRTEHLRLFMEAIVDDPAKS ALNAELFKGFGDDRFRSTPDLWKQHCHFFHDKAEKVVAERFSRWRTETRPKSSSWQDWRERRGYAGGKSYWAV TYLEAVRGLILRWNMRGRTYGEVNRQDKKQFGTVASALLHHINQLKEDRIKTGADMIIQAARGFVPRKNGAGW VQVHEPCRLILFEDLARYRFRIDRSRRENSRLMRWSHREIVNEVGMQGELYGLHVDTTEAGESSRYLASSGAP GVRCRHLVEEDFHDGLPGMHLVGELDWLLPKDKDRTANEARRLLGGMVRPGMLVPWDGGELFATLNAASQLHV IHADINAAQNLQRRFWGRCGEAIRIVCNQLSVDGSTRYEMAKAPKARLLGALQQLKNGDAPFHLTSIPNSQKP ENSYVMTPTNAGKKYRAGPGEKSSGEEDELALDIVEQAEELAQGRKTFFRDPSGVFFAPDRWLPSEIYWSRIR RRIWQVTLERNSSGRQERAEMDEMPY (SEQ ID NO: 83) |

The base editors described herein may also comprise Cas12a/Cpf1 (dCpf) variants that may be used as a guide nucleotide sequence-programmable DNA-binding protein domain. The Cas12a/Cpf1 protein has a RuvC-like endonuclease domain that is similar to the RuvC domain of Cas9 but does not have a HNH endonuclease domain, and the N-terminal of Cpf does not have the alfa-helical recognition lobe of Cas9. It was shown in Zetsche et al, *Cell,* 163, 759-771, 2015 (which is incorporated herein by reference) that, the RuvC-like domain of Cpf is responsible for cleaving both DNA strands and inactivation of the RuvC-like domain inactivates Cpf1 nuclease activity.

(8) Cas9Equivalents with Expanded PAM Sequence

In some embodiments, the napDNAbp is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 2016 July; 34(7):768-73. PubMed PMID: 27136078: Swarts et al., *Nature.* 507(7491) (2014): 258-61; and Swarts et al., *Nucleic Acids Res.* 43(10) (2015): 5120-9, each of which is incorporated herein by reference.

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", Biol Direct. 2009 Aug. 25:4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the napDNAbp is a single effector of a microbial CRISPR-Cas system. Single effectors of microbial CRISPR-Cas systems include, without limitation, Cas9, Cpf1, C2c1. C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell.* 2015 Nov. 5; 60(3): 385-397, the entire contents of which is hereby incorporated by reference. Effectors of two of the systems. C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1, C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See. e.g., East-Seletsky, et al., "Two distinct RNase activities of CRISPR-C2c2 enable guide-RNA processing and RNA detection", Nature, 2016 Oct. 13; 538(7624):270-273, the entire contents of which are hereby incorporated by reference. In vitro biochemical analysis of C2c2 in Leptotrichia shahii has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease". *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the napDNAbp may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the napDNAbp is a naturally-occurring C2c1, C2c2, or C2c3 protein.

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "editing window"), which is approximately 15 bases upstream of the PAM. See Komor, A. C., et al., "Programmable editing of a target base in genomic DNA without double-stranded DNA cleavage" *Nature* 533. 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481485 (2015); and Kleinstiver. B. P., et al., "Broadening the targeting range of *Staphylococcus aureus* CRISPR-Cas9 by modifying PAM recognition" *Nature Biotechnology* 33, 1293-1298 (2015): the entire contents of each are hereby incorporated by reference.

For example, a napDNAbp domain with altered PAM specificity, such as a domain with at least 80%, at least 85%, at least 90%, at least 95%, or at least 99% sequence identity with wild type *Francisella novicida* Cpf1 (SEQ ID NO: 84) (D917, E 1006, and D 1255), which has (SEQ ID NO: 84)
```
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKENTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLEDDLKAQKLDLSKIYFKNDKSLT

DLSQQVEDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQINNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA
```

-continued

NKNKDNPKKESVFEYDLIKDKRFTEDKFFFHCPITINFKSSGANKENDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKIGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINERNSDKNHNWDTREVYPTKELEKLLKDYSIEYGHGECIKAAICGESD

KKFFAKLISVLNTILQMRNSKTGTELDYLISPVADVNGNFFDSRQAPKNM

PQDADANGAYHIGLKGLMLLGRIKNNQEGKKLNLVIKNEEYFEFVQNRNN

An additional napDNAbp domain with altered PAM specificity, such as a domain having at least 80%, at least 85%, at least 90%, at least 95%, or at least 99% sequence identity with wild type *Geobacillus thermodenitrificans* Cas9 (SEQ ID NO: 85), which has the following amino acid sequence:

(SEQ ID NO: 85)

MKYKIGLDIGITSIGWAVINLDIPRIEDLGVRIFDRAENPKTGESLALPR

RLARSARRRLRRRKHRLERIRRLFVREGILTKEELNKLFEKKHEIDVWQL

RVEALDRKLNNDELARILLHLAKRRGERSNRKSERINKENSTMLKHIEEN

QSILSSYRTVAEMVVKDPKFSLHKRNKEDNYTNTVARDDLEREIKLIFAK

QREYGNIVCTEAFEHEYISIWASQRPFASKDDIEKKVGFCTFEPKEKRAP

KATYTFQSFTVWEHINKLRLVSPGGIRALTDDERRLIYKQAFHKNKITFH

DVRILLNLPDDTRFKGLLYDRNTTLKENEKVRFLELGAYHKIRKAIDSVY

GKGAAKSFRPIDFDTFGYALTMEKDDTDIRSYLRNEYEQNGKRMENLADK

VYDEELIEELLNLSFSKFGHLSLKALRNILPYMEQGEVYSTACERAGYTF

TGPKKKQKTVLLPNIPPIANPVVMRALTQARKVVNAIIKKYGSPVSIHIE

LARELSQSFDERRKMQKEQEGNRKKNETAIRQLVEYGLILNPTGLDIVKF

KLWSEQNGKCAYSLQPIEIERLLEPGYTEVDHVIPYSRSLDDSYTNKVLV

LIKENREKGNRTPAEYLGLGSERWQQFETFVLINKQFSKKKRDRLLRLHY

DENEENEFKNRNLNDTRYISRFLANFIREHLKFADSDDKQKVYTVNGRIT

AHLRSRWNENKNREESNLHHAVDAAIVACTTPSDIARVTAFYQRREQNKE

LSKKTDPQFPQPWPHFADELQARLSKNPKESIKALNLGNYDNEKLESLQP

VFVSRMPKRSITGAAHQETLRRYIGIDERSGKIQTVVKKKLSEIQLDKTG

HFPMYGKESDPRTYEAIRQRLLEHNNDPKKAFQEPLYKPKKNGELGPIIR

TIKIIDTTNQVIPLNDGKTVAYNSNIVRVDVFEKDGKYYCVPIYTIDMMK

GILPNKAIEPNKPYSEWKEMTEDYTFRFSLYPNDLIRIEFPPREKTIKTAV

GEEIKIKDLFAYYQTIDSSNGGLSLVSHDNNFSLRSIGSRTLKRFEKYQV

DVLGNIYKVRGEKRVGVASSSHSKAGETIRPL

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 34(7): 768-73 (2016), PubMed PMID: 27136078; Swarts et al., *Nature*, 507(7491): 258-61 (2014); and Swarts et al., *Nucleic Acids Res.* 43(10) (2015): 5120-9, each of which is incorporated herein by reference. The sequence of *Natronobacterium gregoryi* Argonaute is provided in SEQ ID NO: 63.

The disclosed fusion proteins may comprise a napDNAbp domain having at least 80%, at least 85%, at least 90%, at least 95%, or at least 99% sequence identity with wild type *Natronobacterium gregoryi* Argonaute (SEQ ID NO: 86), which has the following amino acid sequence:

(SEQ ID NO: 86)

MTVIDLDSTTTADELTSGHTYDISVTLIGVYDNTDEQHPRMS

LAFEQDNGERRYITLWKNTTPKDVFTYDYATGSTYIFTNID

YEVKDGYENLTATYQTTVENATAQEVGTTDEDETFAGGEPLD

HHLDDALNETPDDAETESDSGHVMTSFASRDQLPEWTLHTY

TLTATDGAKTDTEYARRTLAYTVRQELYTDHDAAPVATDGLM

LLTPEPLGETPLDLDCGVRVEADETRTLDYTTAKDRLLARE

LVEEGLKRSLWDDYLVRGIDEVLSKEPVLTCDEFDLHERYDL

SVEVGHSGRAYLHINFRHRFVPKLTLADIDDDNIYPGLRVK

TTYRPRRGHIVWGLRDECATDSLNTLGNQSVVAYHRNNQTPI

NTDLLDAIEAADRRVVETRROGHGDDAVSFPQELLAVEPNT

HQIKQFASDGFHQQARSKTRLSASRCSEKAQAFAERLDPVRL

NGSTVEFSSEFFTGNNEQQLRLLYENGESVLTFRDGARGAH

PDETFSKGIVNPPESFEVAVVLPEQQADTCKAQWDTMADLLN

QAGAPPTRSETVQYDAFSSPESISLNVAGAIDPSEVDAAFV

VLPPDQEGFADLASPTETYDELKKALANMGIYSQMAYFDRFR

DAKIFYTRNVALGLLAAAGGVAFTTEHAMPGDADMFIGIDV

SRSYPEDGASGQINIAATATAVYKDGTILGHSSTRPQLGEKL

QSTDVRDIMKNAILGYQQVTGESPTHIVIHRDGFMNEDLDP

ATEFLNEQGVEYDIVEIRKQPQTRLLAVSDVQYDTPVKSIAA

INQNEPRATVATFGAPEYLATRDGGGLPRPIQIERVAGETD

IETLTRQVYLLSQSHIQVHNSTARLPITTAYADQASTHATKG

YLVQTGAFESNVGFL (9) Cas9 Circular Permutants

In various embodiments, the base editors disclosed herein may comprise a circular permutant of Cas9.

The term "circularly permuted Cas9" or "circular permutant" of Cas9 or "CP-Cas9") refers to any Cas9 protein, or variant thereof, that occurs or has been modify to engineered as a circular permutant variant, which means the N-terminus and the C-terminus of a Cas9 protein (e.g., a wild type Cas9 protein) have been topically rearranged. Such circularly permuted Cas9 proteins, or variants thereof, retain the ability to bind DNA when complexed with a guide RNA (gRNA). See, Oakes et al., "Protein Engineering of Cas9 for enhanced function," *Methods Enzymol,* 2014, 546: 491-511 and Oakes et al., "CRISPR-Cas9 Circular Permutants as Programmable Scaffolds for Genome Modification." *Cell*, Jan. 10, 2019, 176: 254-267, each of are incorporated herein by reference. The instant disclosure contemplates any previously known CP-Cas9 or use a new CP-Cas9 so long as the resulting circularly permuted protein retains the ability to bind DNA when complexed with a guide RNA (gRNA).

Any of the Cas9 proteins described herein, including any variant, ortholog, or naturally occurring Cas9 or equivalent thereof, may be reconfigured as a circular permutant variant.

In various embodiments, the circular permutants of Cas9 may have the following structure:

N-terminus-[original C-terminus]-[optional linker]-[original N-terminus]-C-terminus.

As an example, the present disclosure contemplates the following circular permutants of canonical *S. pyogenes* Cas9 (1368 amino acids of UniProtKB-Q99ZW2 (CAS9_STRP1) (numbering is based on the amino acid position in SEQ ID NO: 28)):

- N-terminus-[1268-1368]-[optional linker]-[1-1267]-C-terminus;
- N-terminus-[1168-1368]-[optional linker]-[1-1167]-C-terminus;
- N-terminus-[1068-1368]-[optional linker]-[1-1067]-C-terminus;
- N-terminus-[968-1368]-[optional linker]-[1-967]-C-terminus;
- N-terminus-[868-1368]-[optional linker]-[1-867]-C-terminus;
- N-terminus-[768-1368]-[optional linker]-[1-767]-C-terminus;
- N-terminus-[668-1368]-[optional linker]-[1-667]-C-terminus;
- N-terminus-[568-1368]-[optional linker]-[1-567]-C-terminus;
- N-terminus-[468-1368]-[optional linker]-[1-467]-C-terminus;
- N-terminus-[368-1368]-[optional linker]-[1-367]-C-terminus;
- N-terminus-[268-1368]-[optional linker]-[1-267]-C-terminus;
- N-terminus-[168-1368]-[optional linker]-[1-167]-C-terminus;
- N-terminus-[68-1368]-[optional linker]-[1-67]-C-terminus; or
- N-terminus-[10-1368]-[optional linker]-[1-9]-C-terminus, or the corresponding circular permutants of other Cas9 proteins (including other Cas9 orthologs, variants, etc).

In particular embodiments, the circular permuant Cas9 has the following structure (based on *S. pyogenes* Cas9 (1368 amino acids of UniProtKB—Q99ZW2 (CAS9_STRP1) (numbering is based on the amino acid position in SEQ ID NO: 28):

- N-terminus-[102-1368]-[optional linker]-[1-101]-C-terminus;
- N-terminus-[1028-1368]-[optional linker]-[1-1027]-C-terminus;
- N-terminus-[1041-1368]-[optional linker]-[1-1043]-C-terminus;
- N-terminus-[1249-1368]-[optional linker]-[1-1248]-C-terminus; or
- N-terminus-[1300-1368]-[optional linker]-[1-1299]-C-terminus, or the corresponding circular permutants of other Cas9 proteins (including other Cas9 orthologs, variants, etc).

In still other embodiments, the circular permuant Cas9 has the following structure (based on *S. pyogenes* Cas9 (1368 amino acids of UniProtKB—Q99ZW2 (CAS9_STRP1) (numbering is based on the amino acid position in SEQ ID NO: 28):

- N-terminus-[103-1368]-[optional linker]-[1-102]-C-terminus;
- N-terminus-[1029-1368]-[optional linker]-[1-1028]-C-terminus;
- N-terminus-[1042-1368]-[optional linker]-[1-1041]-C-terminus;
- N-terminus-[1250-1368]-[optional linker]-[1-1249]-C-terminus; or
- N-terminus-[1301-1368]-[optional linker]-[1-1300]-C-terminus, or the corresponding circular permutants of other Cas9 proteins (including other Cas9 orthologs, variants, etc).

In some embodiments, the circular permutant can be formed by linking a C-terminal fragment of a Cas9 to an N-terminal fragment of a Cas9, either directly or by using a linker, such as an amino acid linker. In some embodiments. The C-terminal fragment may correspond to the C-terminal 95% or more of the amino acids of a Cas9 (e.g., amino acids about 1300-1368), or the C-terminal 90%, 85%, 80%, 75%, 70%, 65%, 60%, 55%, 50%, 45%, 40%, 35%, 30%, 25%, 20%, 15%, 10%, or 5% or more of a Cas9 (e.g., any one of SEQ ID NO: 28, 8, 10, 12-26). The N-terminal portion may correspond to the N-terminal 95% or more of the amino acids of a Cas9 (e.g., amino acids about 1-1300), or the N-terminal 90%, 85%, 80%, 75%, 70%, 65%, 60%, 55%, 50%, 45%, 40%, 35%, 30%, 25%, 20%, 15%, 10%, or 5% or more of a Cas9 (e.g., of SEQ ID NO: 28, 8, 10, 12-26).

In some embodiments, the circular permutant can be formed by linking a C-terminal fragment of a Cas9 to an N-terminal fragment of a Cas9, either directly or by using a linker, such as an amino acid linker. In some embodiments, the C-terminal fragment that is rearranged to the N-terminus, includes or corresponds to the C-terminal 30% or less of the amino acids of a Cas9 (e.g., amino acids 1012-1368 of SEQ ID NO: 28). In some embodiments, the C-terminal fragment that is rearranged to the N-terminus, includes or corresponds to the C-terminal 30%. 29%, 28%, 27%, 26%. 25%, 24%, 23%, 22%, 21%, 20%, 19%. 18%, 17%, 16%, 15%, 14%. 13%, 12%, 11%, 10%. 9%, 8%, 7%, 6%, 5%, 4%, 3%, 2%, or 1% of the amino acids of a Cas9 (e.g., the Cas9 of SEQ ID NO: 28). In some embodiments, the C-terminal fragment that is rearranged to the N-terminus, includes or corresponds to the C-terminal 410 residues or less of a Cas9 (e.g., the Cas9 of SEQ ID NO: 28). In some embodiments, the C-terminal portion that is rearranged to the N-terminus, includes or corresponds to the C-terminal 410, 400, 390, 380, 370, 360, 350, 340, 330, 320, 310, 300, 290, 280, 270, 260, 250, 240, 230, 220, 210, 200, 190, 180, 170, 160, 150, 140, 130, 120, 110, 100, 90, 80, 70, 60, 50, 40, 30, 20, or 10 residues of a Cas9 (e.g., the Cas9 of SEQ ID NO: 5). In some embodiments, the C-terminal portion that is rearranged to the N-terminus, includes or corresponds to the C-terminal 357, 341, 328, 120, or 69 residues of a Cas9 (e.g., the Cas9 of SEQ ID NO: 28).

In other embodiments, circular permutant Cas9 variants may be defined as a topological rearrangement of a Cas9 primary structure based on the following method, which is based on *S. pyogenes* Cas9 of SEQ ID NO: 28: (a) selecting a circular permutant (CP) site corresponding to an internal amino acid residue of the Cas9 primary structure, which dissects the original protein into two halves: an N-terminal region and a C-terminal region; (b) modifying the Cas9 protein sequence (e.g., by genetic engineering techniques) by moving the original C-terminal region (comprising the CP site amino acid) to preceed the original N-terminal region, thereby forming a new N-terminus of the Cas9 protein that now begins with the CP site amino acid residue. The CP site can be located in any domain of the Cas9 protein, including, for example, the helical-II domain, the RuvCIII domain, or the CTD domain. For example, the CP site may be located (relative the *S. pyogenes* Cas9 of SEQ ID NO: 28) at original amino acid residue 181, 199, 230, 270, 310, 1010, 1016, 1023, 1029, 1041, 1247, 1249, or 1282. Thus, once relocated to the N-terminus, original amino acid 181, 199, 230, 270, 310, 1010, 1016, 1023, 1029, 1041, 1247, 1249, or 1282 would become the new N-terminal amino acid. Nomenclature of these CP-Cas9 proteins may be referred to as Cas9-$CP^{181}$, Cas9-$CP^{199}$, Cas9-$CP^{230}$, Cas9-$CP^{270}$, Cas9-$CP^{310}$, Cas9-$CP^{1010}$, Cas9-$CP^{1016}$, Cas9-$CP^{1023}$, Cas9-$CP^{1029}$, Cas9-$CP^{1041}$, Cas9-$CP^{1247}$, Cas9-$CP^{1249}$, and Cas9-$CP^{1282}$, respectively. This description is not meant to be limited to making CP variants from SEQ ID NO: 28, but may be implemented to make CP variants in any Cas9 sequence, either at CP sites that correspond to these positions, or at other CP sites entirely. This description is not meant to limit the specific CP sites in any way. Virtually any CP site may be used to form a CP-Cas9 variant.

Exemplary CP-Cas9 amino acid sequences, based on the Cas9 of SEQ ID NO: 28, are provided below in which linker sequences are indicated by underlining and optional methionine (M) residues are indicated in bold. It should be appreciated that the disclosure provides CP-Cas9 sequences that do not include a linker sequence or that include different linker sequences. It should be appreciated that CP-Cas9 sequences may be based on Cas9 sequences other than that of SEQ ID NO: 28 and any examples provided herein are not meant to be limiting. Exemplary CP-Cas9 sequences are as follows:

| CP name | Sequence | SEQ ID NO: |
|---|---|---|
| CP1012 | DYKVYDVRKMIAKSEQEIGKATAKYFFYSNIMNFFKTEITLANGEIRKRPLIETN<br>GETGEIVWDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIMERSSFEK<br>NPIDFLEAKGYKEVKKDLIIKLPKYSLFELENGRKRMLASAGELQKGNELALPSK<br>YVNFLYLASHYEKLKGSPEDNEQKQLFVEQHKHYLDEIIEQISEFSKRVILADAN<br>LDKVLSAYNKHRDKPIREQAENIIHLFTLTNLGAPAAFKYFDTTIDRKRYTSTKE<br>VLDATLIHQSITGLYETRIDLSQLGGDGGSGGSGGSGGSGGSGGDKKYSIGL<br>AIGTNSVGWAVITDEYKVPSKKFKVLGNTDRHSIKKNLIGALLFDSGETAEATRL<br>KRTARRRYTRRKNRICYLQEIFSNEMAKVDDSFFHRLEESFLVEEDKKHERHPIF<br>GNIVDEVAYHEKYPTIYHLRKKLVDSTDKADLRLIYLALAHMIKFRGHFLIEGDL<br>NPDNSDVDKLFIQLVQTYNQLFEENPINASGVDAKAILSARLSKSRRLENLIAQL<br>PGEKKNGLFGNLIALSLGLTPNFKSNFDLAEDAKLQLSKDTYDDDLDNLLAQIGD<br>QYADLFLAAKNLSDAILLSDILRVNTEITKAPLSASMIKRYDEHHQDLTLLKALV<br>RQQLPEKYKEIFFDQSKNGYAGYIDGGASQEEFYKFIKPILEKMDGTEELLVKLN<br>REDLLRKQRTFDNGSIPHQIHLGELHAILRRQEDFYPFLKDNREKIEKILTFRIP<br>YYVGPLARGNSRFAWMTRKSEETITPWNFEEVVDKGASAQSFIERMINEDKNLPN<br>EKVLPKHSLLYEYFTVYNELTKVKYVTEGMRKPAFLSGEQKKAIVDLLFKTNRKV<br>TVKQLKEDYFKKIECFDSVEISGVEDRENASLGTYHDLLKIIKDKDFLDNEENED<br>ILEDIVLILTLFEDREMIEERLKTYAHLEDDKVMKQLKRRRYTGWGRLSRKLING<br>IRDKQSGKTILDFLKSDGFANRNFMQLIHDDSLTFKEDIQKAQVSGQGDSLHEHI<br>ANLAGSPAIKKGILQTVKVVDELVKVMGRHKPENIVIEMARENQTTQKGQKNSRE<br>RMKRIEEGIKELGSQILKEHPVENTQLQNEKLYLYYLQNGRDMYVDQELDINRLS<br>DYDVDHIVPQSFLKDDSIDNKVLTRSDKNRGKSDNVPSEEVVKKMKNYWRQLLNA<br>KLITQRKFDNLTKAERGGLSELDKAGFIKRQLVETRQITKHVAQILDSRMNTKYD<br>ENDKLIREVKVITLKSKLVSDFRKDFQFYKVREINNYHHAHDAYLNAVVGTALIK<br>KYPKLESEFVYG | SEQ ID NO: 87 |
| CP1028 | EIGKATAKYFFYSNIMNFFKTEITLANGEIRKRPLIETNGETGEIVWDKGRDFAT<br>VRKVLSMPQVNIVKKTEVQTGGFSKESILPKRNSDKLIARKKDWDPKKYGGFDSP<br>TVAYSVLVVAKVEKGKSKKLKSVKELLGITIMERSSFEKNPIDFLEAKGYKEVKK<br>DLIIKLPKYSLFELENGRKRMLASAGELQKGNELALPSKYVNFLYLASHYEKLKG<br>SPEDNEQKQLFVEQHKHYLDEIIEQISEFSKRVILADANLDKVLSAYNKHRDKPI<br>REQAENIIHLFTLTNLGAPAAFKYFDTTIDRKRYTSTKEVLDATLIHQSITGLYE<br>TRIDLSQLGGDGGSGGSGGSGGSGGSGG**M**DKKYSIGLAIGTNSVGWAVITDE<br>YKVPSKKFKVLGNTDRHSIKKNLIGALLFDSGETAEATRLKRTARRRYTRRKNRI<br>CYLQEIFSNEMAKVDDSFFHRLEESFLVEEDKKHERHPIFGNIVDEVAYHEKYPT<br>IYHLRKKLVDSTDKADLRLIYLALAHMIKFRGHFLIEGDLNPDNSDVDKLFIQLV<br>QTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDA<br>ILLSDILRVNTEITKAPLSASMIKRYDEHHQDLTLLKALVRQQLPEKYKEIFFDQ<br>SKNGYAGYIDGGASQEEFYKFIKPILEKMDGTEELLVKLNREDLLRKQRTFDNGS<br>IPHQIHLGELHAILRRQEDFYPFLKDNREKIEKILTFRIPYYVGPLARGNSRFAW<br>MTRKSEETITPWNFEEVVDKGASAQSFIERMTNFDKNLPNEKVLPKHSLLYEYFT<br>VYNELTKVKYVTEGMRKPAFLSGEQKKAIVDLLFKTNRKVTVKQLKEDYFKKIEC<br>FDSVEISGVEDRFNASLGTYHDLLKIIKDKDELDNEENEDILEDIVLTLTLFEDR<br>EMIEERLKTYAHLFDDKVMKQLKRRRYTGWGRLSRKLINGIRDKQSGKTILDFLK<br>SDGFANRNFMQLIHDDSLTFKEDIQKAQVSGQGDSLHEHIANLAGSPAIKKGILQ<br>TVKVVDELVKVMGRHKPENIVIEMARENQTTQKGQKNSRERMKRIEEGIKELGSQ<br>ILKEHPVENTQLQNEKLYLYYLQNGRDMYVDQELDINRLSDYDVDHIVPQSFLKD<br>DSIDNKVLTRSDKNRGKSDNVPSEEVVKKMKNYWRQLLNAKLITQRKFDNLTKAE<br>RGGLSELDKAGFIKRQLVETRQITKHVAQILDSRMNTKYDENDKLIREVKVITLK<br>SKLVSDFRKDFQFYKVREINNYHHAHDAYLNAVVGTALIKKYPKLESEFVYGDYK<br>VYDVRKMIAKSEQ | SEQ ID NO: 88 |

-continued

| CP name | Sequence | SEQ ID NO: |
|---|---|---|
| CP1041 | NIMNFFKTEITLANGEIRKRPLIETNGETGEIVWDKGRDFATVRKVLSMPQVNIV<br>KKTEVQTGGFSKESILPKRNSDKLIARKKDWDPKKYGGFDSPTVAYSVLVVAKVE<br>KGKSKKLKSVKELLGITIMERSSFEKNPIDFLEAKGYKEVKKDLIIKLPKYSLFE<br>LENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTL<br>TNLGAPAAFKYFDTTIDRKRYTSTKEVLDATLIHQSITGLYETRIDLSQLGGDGG<br>SGGSGGSGGSGGSGGSGGDKKYSIGLAIGTNSVGWAVITDEYKVPSKKFKVLGNT<br>DRHSIKKNLIGALLFDSGETAEATRLKRTARRRYTRRKNRICYLQEIFSNEMAKV<br>DDSFFHRLEESFLVEEDKKHERHPIFGNIVDEVAYHEKYPTIYHLRKKLVDSTDK<br>ADLRLIYLALAHMIKFRGHFLIEGDLNPDNSDVDKLFIQLVQTYNQLFEENPINA<br>SGVDAKAILSARLSKSRRLENLIAQLPGEKKNGLFGNLIALSLGLIPNFKSNFDL<br>AEDAKLQLSKDTYDDDLDNLLAQIGDQYADLFLAAKNLSDAILLSDILRVNTEIT<br>KAPLSASMIKRYDEHHQDLTLLKALVRQQLPEKYKEIFFDQSKNGYAGYIDGGAS<br>QEEFYKFIKPILEKMDGTEELLVKLNREDLLRKQRTEDNGSIPHQIHLGELHAIL<br>RRQEDFYPFLKDNREKIEKILTFRIPYYVGPLARGNSRFAWMTRKSEETITPWNF<br>EEVVDKGASAQSFIERMTNFDKNLPNEKVLPKHSLLYEYFTVYNELTKVKYVTEG<br>MRKPAFLSGEQKKAIVDLLFKTNRKVTVKQLKEDYFKKIECFDSVEISGVEDREN<br>ASLGTYHDLLKIIKDKDELDNEENEDILEDIVLTLTLFEDREMIEERLKTYAHLE<br>DDKVMKQLKRRRYTGWGRLSRKLINGIRDKQSGKTILDELKSDGFANRNEMQLIH<br>DDSLTFKEDIQKAQVSGQGDSLHEHIANLAGSPAIKKGILQTVKVVDELVKVMGR<br>HKPENIVIEMARENQTTQKGQKNSRERMKRIEEGIKELGSQILKEHPVENTQLQN<br>EKLYLYYLQNGRDMYVDQELDINRLSDYDVDHIVPQSFLKDDSIDNKVLTRSDKN<br>RGKSDNVPSEEVVKKMKNYWRQLLNAKLITQRKFDNLTKAERGGLSELDKAGFIK<br>RQLVETRQITKHVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSEQE<br>IGKATAKYFFYS | SEQ ID NO: 89 |
| CP1249 | PEDNEQKQLFVEQHKHYLDEIIEQISEFSKRVILADANLDKVLSAYNKHRDKPIR<br>EQAENIIHLFTLTNLGAPAAFKYFDTTIDRKRYTSTKEVLDATLIHQSITGLYET<br>RIDLSQLGGDGGSGGSGGSGGSGGSGGSGGMDKKYSIGLAIGTNSVGWAVITDEY<br>KVPSKKFKVLGNTDRHSIKKNLIGALLFDSGETAEATRLKRTARRRYTRRKNRIC<br>YLQEIFSNEMAKVDDSFFHRLEESFLVEEDKKHERHPIFGNIVDEVAYHEKYPTI<br>YHLRKKLVDSTDKADLRLIYLALAHMIKFRGHFLIEGDLNPDNSDVDKLFIQLVQ<br>TYNQLFEENPINASGVDAKAILSARLSKSRRLENLIAQLPGEKKNGLFGNLIALS<br>LGLTPNFKSNFDLAEDAKLQLSKDTYDDDLDNLLAQIGDQYADLFLAAKNLSDAI<br>LLSDILRVNTEITKAPLSASMIKRYDEHHQDLTLLKALVRQQLPEKYKEIFFDQS<br>KNGYAGYIDGGASQEEFYKFIKPILEKMDGTEELLVKLNREDLLRKQRTFDNGSI<br>PHQIHLGELHAILRRQEDFYPFLKDNREKIEKILTFRIPYYVGPLARGNSRFAWM<br>TRKSEETITPWNFEEVVDKGASAQSFIERMTNFDKNLPNEKVLPKHSLLYEYFTV<br>YNELTKVKYVTEGMRKPAFLSGEQKKAIVDLLFKTNRKVTVKQLKEDYFKKIECE<br>DSVEISGVEDRFNASLGTYHDLLKIIKDKDELDNEENEDILEDIVLTLTLFEDRE<br>MIEERLKTYAHLFDDKVMKQLKRRRYTGWGRLSRKLINGIRDKQSGKTILDELKS<br>DGFANRNFMQLIHDDSLTFKEDIQKAQVSGQGDSLHEHIANLAGSPAIKKGILQT<br>VKVVDELVKVMGRHKPENIVIEMARENQTTQKGQKNSRERMKRIEEGIKELGSQI<br>LKEHPVENTQLQNEKLYLYYLQNGRDMYVDQELDINRLSDYDVDHIVPQSFLKDD<br>SIDNKVLTRSDKNRGKSDNVPSEEVVKKMKNYWRQLLNAKLITQRKFDNLTKAER<br>GGLSELDKAGFIKRQLVETRQITKHVAQILDSRMNTKYDENDKLIREVKVITLKS<br>KLVSDFRKDFQFYKVREINNYHHAHDAYLNAVVGTALIKKYPKLESEFVYGDYKV<br>YDVRKMIAKSEQEIGKATAKYFFYSNIMNFFKTEITLANGEIRKRPLIEINGETG<br>EIVWDKGRDFATVRKVLSMPQVNIVKKTEVQTGGFSKESILPKRNSDKLIARKKD<br>WDPKKYGGFDSPTVAYSVLVVAKVEKGKSKKLKSVKELLGITIMERSSFEKNPID<br>FLEAKGYKEVKKDLIIKLPKYSLFELENGRKRMLASAGELQKGNELALPSKYVNE<br>LYLASHYEKLKGS | SEQ ID NO: 90 |
| CP1300 | KPIREQAENIIHLFTLINLGAPAAFKYFDTTIDRKRYTSTKEVLDATLIHQSITG<br>LYETRIDLSQLGGDGGSGGSGGSGGSGGSGGSGGDKKYSIGLAIGTNSVGWAVIT<br>DEYKVPSKKFKVLGNTDRHSIKKNLIGALLFDSGETAEATRLKRTARRRYTRRKN<br>RICYLQEIFSNEMAKVDDSFFHRLEESFLVEEDKKHERHPIFGNIVDEVAYHEKY<br>PTIYHLRKKLVDSTDKADLRLIYLALAHMIKFRGHFLIEGDLNPDNSDVDKLFIQ<br>LVQTYNQLFEENPINASGVDAKAILSARLSKSRRLENLIAQLPGEKKNGLFGNLI<br>ALSLGLTPNFKSNFDLAEDAKLQLSKDTYDDDLDNLLAQIGDQYADLFLAAKNLS<br>DAILLSDILRVNTEITKAPLSASMIKRYDEHHQDLTLLKALVRQQLPEKYKEIFF<br>DQSKNGYAGYIDGGASQEEFYKFIKPILEKMDGTEELLVKLNREDLLRKQRTFDN<br>GSIPHQIHLGELHAILRRQEDFYPFLKDNREKIEKILTFRIPYYVGPLARGNSRF<br>AWMTRKSEETITPWNFEEVVDKGASAQSFIERMTNFDKNLPNEKVLPKHSLLYEY<br>FTVYNELTKVKYVTEGMRKPAFLSGEQKKAIVDLLFKTNRKVTVKQLKEDYFKKI<br>ECFDSVEISGVEDRENASLGTYHDLLKIIKDKDELDNEENEDILEDIVLTLTLFE<br>DREMIEERLKTYAHLFDDKVMKQLKRRRYTGWGRLSRKLINGIRDKQSGKTILDF<br>LKSDGFANRNEMQLIHDDSLTFKEDIQKAQVSGQGDSLHEHIANLAGSPAIKKGI<br>LQTVKVVDELVKVMGRHKPENIVIEMARENQTTQKGQKNSRERMKRIEEGIKELG<br>SQILKEHPVENTQLQNEKLYLYYLQNGRDMYVDQELDINRLSDYDVDHIVPQSFL<br>KDDSIDNKVLTRSDKNRGKSDNVPSEEVVKKMKNYWRQLLNAKLITQRKEDNLTK<br>AERGGLSELDKAGFIKRQLVETRQITKHVAQILDSRMNTKYDENDKLIREVKVIT<br>LKSKLVSDFRKDFQFYKVREINNYHHAHDAYLNAVVGTALIKKYPKLESEFVYGD<br>YKVYDVRKMIAKSEQEIGKATAKYFFYSNIMNFFKTEITLANGEIRKRPLIETNG<br>ETGEIVWDKGRDFATVRKVLSMPQVNIVKKTEVQTGGFSKESILPKRNSDKLIAR | SEQ ID NO: 91 |

-continued

| CP name | Sequence | SEQ ID NO: |
|---|---|---|
| | KKDWDPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELALPSKY VNFLYLASHYEKLKGSPEDNEQKQLFVEQHKHYLDEIIEQISEFSKRVILADANL DKVLSAYNKHRD | |

The Cas9 circular permutants that may be useful in the base editing constructs described herein. Exemplary C-terminal fragments of Cas9, based on the Cas9 of SEQ ID NO: 28, which may be rearranged to an N-terminus of Cas9, are provided below. It should be appreciated that such C-terminal fragments of Cas9 are exemplary and are not meant to be limiting. These exemplary CP-Cas9 fragments have the following sequences:

| CP name | Sequence | SEQ ID NO: |
|---|---|---|
| CP1012 C-terminal fragment | DYKVYDVRKMIAKSEQEIGKATAKYFFYSNIMNFFKTEITLANGEIRKRPLIETN GETGEIVWDKGRDFATVRKVLSMPQVNIVKKTEVQTGGFSKESILPKRNSDKLIA RKKDWDPKKYGGFDSPTVAYSVLVVAKVEKGKSKKLKSVKELLGITIMERSSFEK NPIDFLEAKGYKEVKKDLIIKLPKYSLFELENGRKRMLASAGELQKGNELALPSK YVNFLYLASHYEKLKGSPEDNEQKQLFVEQHKHYLDEIIEQISEFSKRVILADAN LDKVLSAYNKHRDKPIREQAENIIHLFTLINLGAPAAFKYFDTTIDRKRYTSTKE VLDATLIHQSITGLYETRIDLSQLGGD | 92 |
| CP1028 C-terminal fragment | EIGKATAKYFFYSNIMNFFKTEITLANGEIRKRPLIEINGETGEIVWDKGRDFAT VRKVLSMPQVNIVKKTEVQTGGFSKESILPKRNSDKLIARKKDWDPKKYGGEDSP TVAYSVLVVAKVEKGKSKKLKSVKELLGITIMERSSFEKNPIDFLEAKGYKEVKK DLIIKLPKYSLFELENGRKRMLASAGELQKGNELALPSKYVNFLYLASHYEKLKG SPEDNEQKQLFVEQHKHYLDEIIEQISEFSKRVILADANLDKVLSAYNKHRDKPI REQAENIIHLFTLTNLGAPAAFKYFDTTIDRKRYTSTKEVLDATLIHQSITGLYE TRIDLSQLGGD | 93 |
| CP1041 C-terminal fragment | NIMNFFKTEITLANGEIRKRPLIETNGETGEIVWDKGRDFATVRKVLSMPQVNIV KKTEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSLFE LENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTL TNLGAPAAFKYFDTTIDRKRYTSTKEVLDATLIHQSITGLYETRIDLSQLGGD | 94 |
| CP1249 C-terminal fragment | PEDNEQKQLFVEQHKHYLDEIIEQISEFSKRVILADANLDKVLSAYNKHRDKPIR EQAENIIHLFTLINLGAPAAFKYFDTTIDRKRYTSTKEVLDATLIHQSITGLYET RIDLSQLGGD | 95 |
| CP1300 C-terminal fragment | KPIREQAENIIHLFTLTNLGAPAAFKYFDTTIDRKRYTSTKEVLDATLIHQSITG LYETRIDLSQLGGD | 96 |

(10) Cas9 Variants with Modified PAM Specificities

The base editors of the present disclosure may also comprise Cas9 variants with modified PAM specificities. For example, the base editors described herein may utilize any naturally oc curing or engineered variant of SpCas9 having expanded and/or relaxed PAM specificities which are described in the literature, including in Nishimasu et al., "Engineered CRISPR-Cas9 nuclease with expanded targeting space," *Science,* 2018, 361: 1259-1262; Chatterjee et al., "Robust Genome Editing of Single-Base PAM Targets with Engineered ScCas9 Variants," *BioRxiv*, Apr. 26, 2019Some aspects of this disclosure provide Cas9 proteins that exhibit activity on a target sequence that does not comprise the canonical PAM (5'-NGG-3', where N is A, C, G, or T) at its 3'-end. In some embodiments, the Cas9 protein exhibits activity on a target sequence comprising a 5'-NGG-3' PAM sequence at its 3'-end. In some embodiments, the Cas9 protein exhibits activity on a target sequence comprising a 5'-NNG-3' PAM sequence at its 3'-end. In some embodiments, the Cas9 protein exhibits activity on a target sequence comprising a 5'-NNA-3' PAM sequence at its 3'-end. In some embodiments, the Cas9 protein exhibits activity on a target sequence comprising a 5'-NNC-3' PAM sequence at its 3'-end. In some embodiments, the Cas9 protein exhibits activity on a target sequence comprising a 5'-NNT-3' PAM sequence at its 3'-end. In some embodiments, the Cas9 protein exhibits activity on a target sequence comprising a 5'-NGT-3' PAM sequence at its 3'-end. In some embodiments, the Cas9 protein exhibits activity on a target sequence comprising a 5'-NGA-3' PAM sequence at its 3'-end. In some embodiments, the Cas9 protein exhibits activity on a target sequence comprising a 5'-NGC-3' PAM sequence at its 3'-end. In some embodiments, the Cas9 protein exhibits activity on a target sequence comprising a 5'-NAA-3' PAM sequence at its 3'-end. In some embodiments, the Cas9 protein exhibits activity on a target sequence comprising a 5'-NAC-3' PAM sequence at its 3'-end. In some embodiments, the Cas9 protein exhibits activity on a target sequence comprising a 5'-NAT-3' PAM sequence at its 3'-end. In still other embodiments, the Cas9 protein exhibits activity on a target sequence comprising a 5'-NAG-3' PAM sequence at its 3'-end.

It should be appreciated that any of the amino acid mutations described herein, (e.g., A262T) from a first amino acid residue (e.g., A) to a second amino acid residue (e.g., T) may also include mutations from the first amino acid residue to an amino acid residue that is similar to (e.g., conserved)

the second amino acid residue. For example, mutation of an amino acid with a hydrophobic side chain (e.g., alanine, valine, isoleucine, leucine, methionine, phenylalanine, tyrosine, or tryptophan) may be a mutation to a second amino acid with a different hydrophobic side chain (e.g., alanine, valine, isoleucine, leucine, methionine, phenylalanine, tyrosine, or tryptophan). For example, a mutation of an alanine to a threonine (e.g., a A262T mutation) may also be a mutation from an alanine to an amino acid that is similar in size and chemical properties to a threonine, for example, serine. As another example, mutation of an amino acid with a positively charged side chain (e.g., arginine, histidine, or lysine) may be a mutation to a second amino acid with a different positively charged side chain (e.g., arginine, histidine, or lysine). As another example, mutation of an amino acid with a polar side chain (e.g., serine, threonine, asparagine, or glutamine) may be a mutation to a second amino acid with a different polar side chain (e.g., serine, threonine, asparagine, or glutamine). Additional similar amino acid pairs include, but are not limited to, the following: phenylalanine and tyrosine; asparagine and glutamine; methionine and cysteine: aspartic acid and glutamic acid; and arginine and lysine. The skilled artisan would recognize that such conservative amino acid substitutions will likely have minor effects on protein structure and are likely to be well tolerated without compromising function. In some embodiments, any amino of the amino acid mutations provided herein from one amino acid to a threonine may be an amino acid mutation to a serine. In some embodiments, any amino of the amino acid mutations provided herein from one amino acid to an arginine may be an amino acid mutation to a lysine. In some embodiments, any amino of the amino acid mutations provided herein from one amino acid to an isoleucine, may be an amino acid mutation to an alanine, valine, methionine, or leucine. In some embodiments, any amino of the amino acid mutations provided herein from one amino acid to a lysine may be an amino acid mutation to an arginine. In some embodiments, any amino of the amino acid mutations provided herein from one amino acid to an aspartic acid may be an amino acid mutation to a glutamic acid or asparagine. In some embodiments, any amino of the amino acid mutations provided herein from one amino acid to a valine may be an amino acid mutation to an alanine, isoleucine, methionine, or leucine. In some embodiments, any amino of the amino acid mutations provided herein from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure.

In some embodiments, the Cas9 protein comprises a combination of mutations that exhibit activity on a target sequence comprising a 5'-NAA-3' PAM sequence at its 3'-end. In some embodiments, the combination of mutations are present in any one of the clones listed in Table 1. In some embodiments, the combination of mutations are conservative mutations of the clones listed in Table 1. In some embodiments, the Cas9 protein comprises the combination of mutations of any one of the Cas9 clones listed in Table A.

TABLE A

| NAA PAM Clones<br>Mutations from wild-type SpCas9 (e.g., SEQ ID NO: 28) |
|---|
| D177N, K218R, D614N, D1135N, P1137S, E1219V, A1320V, A1323D, R1333K |
| D177N, K218R, D614N, D1135N, E1219V, Q1221H, H1264Y, A1320V, R1333K |
| A10T, I322V, $409I, E427G, G715C, D1135N, E1219V, Q1221H, H1264Y, A1320V, R1333K |
| A367T, K710E, R1114G, D1135N, P1137S, E1219V, Q1221H, H1264Y, A1320V, R1333K |
| A10T, I322V, S409I, E427G, R753G, D861N, D1135N, K1188R, E1219V, Q1221H, H1264H, A1320V, R1333K |
| A10T, I322V, S409I, E427G, R654L, V743I, R753G, M1021T, D1135N, D1180G, K1211R, E1219V, Q1221H, H1264Y, A1320V, R1333K |
| A10T, I322V, S409I, E427G, V743I, R753G, E762G, D1135N, D1180G, K1211R, E1219V, Q1221H, H1264Y, A1320V, R1333K |
| A10T, I322V, S409I, E427G, R753G, D1135N, D1180G, K1211R, E1219V, Q1221H, H1264Y, S1274R, A1320V, R1333K |
| A10T, I322V, S409I, E427G, A589S, R753G, D1135N, E1219V, Q1221H, H1264H, A1320V, R1333K |
| A10T, I322V, S409I, E427G, R753G, E757K, G865G, D1135N, E1219V, Q1221H, H1264Y, A1320V, R1333K |
| A10T, I322V, S409I, E427G, R654L, R753G, E757K, D1135N, E1219V, Q1221H, H1264Y, A1320V, R1333K |
| A10T, I322V, S409I, E427G, K599R, M631A, R654L, K673E, V743I, R753G, N758H, E762G, D1135N, D1180G, E1219V, Q1221H, Q1256R, H1264Y, A1320V, A1323D, R1333K |
| A10T, I322V, S409I, E427G, R654L, K673E, V743I, R753G, E762G, N869S, N1054D, R1114G, D1135N, D1180G, E1219V, Q1221H, H1264Y, A1320V, A1323D, R1333K |
| A10T, I322V, S409I, E427G, R654L, L727I, V743I, R753G, E762G, R859S, N946D, F1134L, D1135N, D1180G, E1219V, Q1221H, H1264Y, N1317T, A1320V, A1323D, R1333K |
| A10T, I322V, S409I, E427G, R654L, K673E, V743I, R753G, E762G, N803S, N869S, Y1016D, G1077D, R1114G, F1134L, D1135N, D1180G, E1219V, Q1221H, H1264Y, V1290G, L1318S, A1320V, A1323D, R1333K |
| A10T, I322V, S409I, E427G, R654L, K673E, V743I, R753G, E762G, N803S, N869S, Y1016D, G1077D, R1114G, F1134L, D1135N, K1151E, D1180G, E1219V, Q1221H, H1264Y, V1290G, L1318S, A1320V, R1333K |
| A10T, I322V, S409I, E427G, R654L, K673E, V743I, R753G, E762G, N803S, N869S, Y1016D, G1077D, R1114G, F1134L, D1135N, D1180G, E1219V, Q1221H, H1264Y, V1290G, L1318S, A1320V, A1323D, R1333K |
| A10T, I322V, S409I, E427G, R654L, K673E, F693L, V743I, R753G, E762G, N803S, N869S, L921P, Y1016D, G1077D, F1080S, R1114G, D1135N, D1180G, E1219V, Q1221H, H1264Y, L1318S, A1320V, A1323D, R1333K |
| A10T, I322V, S409I, E427G, E630K, R654L, K673E, V743I, R753G, E762G, Q768H, N803S, N869S, Y1016D, G1077D, R1114G, F1134L, D1135N, D1180G, E1219V, Q1221H, H1264Y, L1318S, A1320V, R1333K |

TABLE A-continued

| NAA PAM Clones Mutations from wild-type SpCas9 (e.g., SEQ ID NO: 28) |
|---|
| A10T, I322V, S409I, E427G, R654L, K673E, F693L, V743I, R753G, E762G, Q768H, N803S, N869S, Y1016D, G1077D, R1114G, F1134L, D1135N, D1180G, E1219V, Q1221H, G1223S, H1264Y, L1318S, A1320V, R1333K |
| A10T, I322V, S409I, E427G, R654L, K673E, F693L, V743I, R753G, E762G, N803S, N869S, L921P, Y1016D, G1077D, F1801S, R1114G, D1135N, D1180G, E1219V, Q1221H, H1264Y, L1318S, A1320V, A1323D, R1333K |
| A10T, I322V, S409I, E427G, R654L, V743I, R753G, M1021T, D1135N, D1180G, K1211R, E1219V, Q1221H, H1264Y, A1320V, R1333K |
| A10T, I322V, S409I, E427G, R654L, K673E, V743I, R753G, E762G, M673I, N803S, N869S, G1077D, R1114G, D1135N, V1139A, D1180G, E1219V, Q1221H, A1320V, R1333K |
| A10T, I322V, S409I, E427G, R654L, K673E, V743I, R753G, E762G, N803S, N869S, R1114G, D1135N, E1219V, Q1221H, A1320V, R1333K |

In some embodiments, the Cas9 protein comprises an amino acid sequence that is at least 80% identical to the amino acid sequence of a Cas9 protein as provided by any one of the variants of Table 1. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table A.

In some embodiments, the Cas9 protein exhibits an increased activity on a target sequence that does not comprise the canonical PAM (5'-NGG-3') at its 3' end as compared to *Streptococcus pyogenes* Cas9 as provided by SEQ ID NO: 28. In some embodiments, the Cas9 protein exhibits an activity on a target sequence having a 3' end that is not directly adjacent to the canonical PAM sequence (5'-NGG-3') that is at least 5-fold increased as compared to the activity of *Streptococcus pyogenes* Cas9 as provided by SEQ ID NO: 28 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5.000-fold, at least 10,000-fold, at least 50,000-fold, at least 100,000-fold, at least 500,000-fold, or at least 1.000,000-fold increased as compared to the activity of *Streptococcus pyogenes* as provided by SEQ ID NO: 28 on the same target sequence. In some embodiments, the 3' end of the target sequence is directly adjacent to an AAA, GAA, CAA, or TAA sequence. In some embodiments, the Cas9 protein comprises a combination of mutations that exhibit activity on a target sequence comprising a 5'-NAC-3' PAM sequence at its 3'-end. In some embodiments, the combination of mutations are present in any one of the clones listed in Table 2. In some embodiments, the combination of mutations are conservative mutations of the clones listed in Table 2. In some embodiments, the Cas9 protein comprises the combination of mutations of any one of the Cas9 clones listed in Table B.

TABLE B

| NAC PAM Clones MUTATIONS FROM WILD-TYPE SPCAS9 (E.G., SEQ ID NO: 28) |
|---|
| T472I, R753G, K890E, D1332N, R1335Q, T1337N |
| I1057S, D1135N, P1301S, R1335Q, T1337N |
| T472I, R753G, D1332N, R1335Q, T1337N |
| D1135N, E1219V, D1332N, R1335Q, T1337N |
| T472I, R753G, K890E, D1332N, R1335Q, T1337N |
| I1057S, D1135N, P1301S, R1335Q, T1337N |
| T472I, R753G, D1332N, R1335Q, T1337N |
| T472I, R753G, Q771H, D1332N, R1335Q, T1337N |
| E627K, T638P, K652T, R753G, N803S, K959N, R1114G, D1135N, E1219V, D1332N, R1335Q, T1337N |
| E627K, T638P, K652T, R753G, N803S, K959N, R1114G, D1135N, K1156E, E1219V, D1332N, R1335Q, T1337N |
| E627K, T638P, V647I, R753G, N803S, K959N, G1030R, I1055E, R1114G, D1135N, E1219V, D1332N, R1335Q, T1337N |
| E627K, E630G, T638P, V647A, G687R, N767D, N803S, K959N, R1114G, D1135N, E1219V, D1332G, R1335Q, T1337N |
| E627K, T638P, R753G, N803S, K959N, R1114G, D1135N, E1219V, N1266H, D1332N, R1335Q, T1337N |
| E627K, T638P, R753G, N803S, K959N, I1057T, R1114G, D1135N, E1219V, D1332N, R1335Q, T1337N |
| E627K, T638P, R753G, N803S, K959N, R1114G, D1135N, E1219V, D1332N, R1335Q, T1337N |
| E627K, M631I, T638P, R753G, N803S, K959N, Y1036H, R1114G, D1135N, E1219V, D1251G, D1332G, R1335Q, T1337N |
| E627K, T638P, R753G, N803S, V875I, K959N, Y1016C, R1114G, D1135N, E1219V, D1251G, D1332G, R1335Q, T1337N, I1348V |
| K608R, E627K, T638P, V647I, R654L, R753G, N803S, T804A, K848N, V922A, K959N, R1114G, D1135N, E1219V, D1332N, R1335Q, T1337N |
| K608R, E627K, T638P, V647I, R753G, N803S, V922A, K959N, K1014N, V1015A, R1114G, D1135N, K1156N, E1219V, N1252D, D1332N, R1335Q, T1337N |
| K608R, E627K, R629G, T638P, V647I, A711T, R753G, K775R, K789E, N803S, K959N, V1015A, |

TABLE B-continued

| NAC PAM Clones MUTATIONS FROM WILD-TYPE SPCAS9 (E.G., SEQ ID NO: 28) |
|---|
| Y1036H, R1114G, D1135N, E1219V, N1286H, D1332N, R1335Q, T1337N |
| K608R, E627K, T638P, V647I, T740A, R753G, N803S, K948E, K959N, Y1016S, R1114G, D1135N, E1219V, N1286H, D1332N, R1335Q, T1337N |
| K608R, E627K, T638P, V647I, T740A, N803S, K948E, K959N, Y1016S, R1114G, D1135N, E1219V, N1286H, D1332N, R1335Q, T1337N |
| I670S, K608R, E627K, E630G, T638P, V647I, R653K, R753G, I795L, K797N, N803S, K866R, K890N, K959N, Y1016C, R1114G, D1135N, E1219V, D1332N, R1335Q, T1337N |
| K608R, E627K, T638P, V647I, T740A, G752R, R753G, K797N, N803S, K948E, K959N, V1015A, Y1016S, R1114G, D1135N, E1219V, N1266H, D1332N, R1335Q, T1337N |
| I570T, A589V, K608R, E627K, T638P, V647I, R654L, Q716R, R753G, N803S, K948E, K959N, Y1016S, R1114G, D1135N, E1207G, E1219V, N1234D, D1332N, R1335Q, T1337N |
| K608R, E627K, R629G, T638P, V647I, R654L, Q740R, R753G, N803S, K959N, N990S, T995S, V1015A, Y1036D, R1114G, D1135N, E1207G, E1219V, N1234D, N1266H, D1332N, R1335Q, T1337N |
| I562F, V565D, I570T, K608R, L625S, E627K, T638P, V647I, R654I, G752R, R753G, N803S, N808D, K959N, M1021L, R1114G, D1135N, N1177S, N1234D, D1332N, R1335Q, T1337N |
| I562F, I570T, K608R, E627K, T638P, V647I, R753G, E790A, N803S, K959N, V1015A, Y1036H, R1114G, D1135N, D1180E, A1184T, E1219V, D1332N, R1335Q, T1337N |
| I570T, K608R, E627K, T638P, V647I, R654H, R753G, E790A, N803S, K959N, V1015A, R1114G, D1127A, D1135N, E1219V, D1332N, R1335Q, T1337N |
| I570T, K608R, L625S, E627K, T638P, V647I, R654I, T703P, R753G, N803S, N808D, K959N, M1021L, R1114G, D1135N, E1219V, D1332N, R1335Q, T1337N |
| I570S, K608R, E627K, E630G, T638P, V647I, R653K, R753G, I795L, N803S, K866R, K890N, K959N, Y1016C, R1114G, D1135N, E1219V, D1332N, R1335Q, T1337N |
| I570T, K608R, E627K, T638P, V647I, R654H, R753G, E790A, N803S, K959N, V1016A, R1114G, D1135N, E1219V, K1246E, D1332N, R1335Q, T1337N |
| K608R, E627K, T638P, V647I, R654L, K673E, R753G, E790A, N803S, K948E, K959N, R1114G, D1127G, D1135N, D1180E, E1219V, N1286H, D1332N, R1335Q, T1337N |
| K608R, L625S, E627K, T638P, V647I, R654I, I670T, R753G, N803S, N808D, K959N, M1021L, R1114G, D1135N, E1219V, N1286H, D1332N, R1335Q, T1337N |
| E627K, M631V, T638P, V647I, K710E, R753G, N803S, N808D, K948E, M1021L, R1114G, D1135N, E1219V, D1332N, R1335Q, T1337N, S1338T, H1349R |

In some embodiments, the Cas9 protein comprises an amino acid sequence that is at least 80% identical to the amino acid sequence of a Cas9 protein as provided by any one of the variants of Table 2. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table B.

In some embodiments, the Cas9 protein exhibits an increased activity on a target sequence that does not comprise the canonical PAM (5'-NGG-3') at its 3' end as compared to *Streptococcus pyogenes* Cas9 as provided by SEQ ID NO: 28. In some embodiments, the Cas9 protein exhibits an activity on a target sequence having a 3' end that is not directly adjacent to the canonical PAM sequence (5'-NGG-3') that is at least 5-fold increased as compared to the activity of *Streptococcus pyogenes* Cas9 as provided by SEQ ID NO: 28 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500.000-fold, or at least 1.000,000-fold increased as compared to the activity of *Streptococcus pyogenes* as provided by SEQ ID NO: 28 on the same target sequence. In some embodiments, the 3' end of the target sequence is directly adjacent to an AAC, GAC. CAC, or TAC sequence.

In some embodiments, the Cas9 protein comprises a combination of mutations that exhibit activity on a target sequence comprising a 5'-NAT-3' PAM sequence at its 3'-end. In some embodiments, the combination of mutations are present in any one of the clones listed in Table 3. In some embodiments, the combination of mutations are conservative mutations of the clones listed in Table 3. In some embodiments, the Cas9 protein comprises the combination of mutations of any one of the Cas9 clones listed in Table C.

TABLE C

| NAT PAM Clones MUTATIONS FROM WILD-TYPE SPCAS9 (E. G., SEQ ID NO: 28) |
|---|
| K961E, H985Y, D1135N, K1191N, E1219V, Q1221H, A1320A, P1321S, R1335L |
| D1135N, G1218S, E1219V, Q1221H, P1249S, P1321S, D1322G, R1335L |
| V743I, R753G, E790A, D1135N, G1218S, E1219V, Q1221H, A1227V, P1249S, N1286K, A1293T, P1321S, D1322G, R1335L, T1339I |
| F575S, M631L, R654L, V748I, V743I, R753G, D853E, V922A, R1114G D1135N, G1218S, E1219V, Q1221H, A1227V, P1249S, N1286K, A1293T, P1321S, D1322G, R1335L, T1339I |
| F575S, M631L, R654L, R664K, R753G, D853E, V922A, R1114G D1135N, D1180G, G1218S, E1219V, Q1221H, P1249S, N1286K, P1321S, D1322G, R1335L |
| M631L, R654L, R753G, K797E, D853E, V922A, D1012A, R1114G D1135N, G1218S, E1219V, Q1221H, P1249S, N1317K, P1321S, D1322G, R1335L |
| F575S, M631L, R654L, R664K, R753G, D853E, V922A, R1114G, Y1131C, D1135N, D1180G, |

TABLE C-continued

| NAT PAM Clones MUTATIONS FROM WILD-TYPE SPCAS9 (E. G., SEQ ID NO: 28) |
|---|
| G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, D596Y, M631L, R654L, R664K, R753G, D853E, V922A, R1114G, Y1131C, D1135N, D1180G, G1218S, E1219V, Q1221H, P1249S, Q1256R, P1321S, D1322G, R1335L |
| F575S, M631L, R654L, R664K, K710E, V750A, R753G, D853E, V922A, R1114G, Y1131C, D1135N, D1180G, G1218S, E1219V, Q1221H, P1249S, P1321S, D1322G, R1335L |
| F575S, M631L, K649R, R654L, R664K, R753G, D853E, V922A, R1114G, Y1131C, D1135N, K1156E, D1180G, G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, M631L, R654L, R664K, R753G, D853E, V922A, I1057G, R1114G, Y1131C, D1135N, D1180G, G1218S, E1219V, Q1221H, P1249S, N1308D, P1321S, D1322G, R1335L |
| M631L, R654L, R753G, D853E, V922A, R1114G, Y1131C, D1135N, E1150V, D1180G, G1218S, E1219V, Q1221H, P1249S, P1321S, D1332G, R1335L |
| M631L, R654L, R664K, R753G, D853E, I1057V, Y1131C, D1135N, D1180G, G1218S, E1219V, Q1221H, P1249S, P1321S, D1332G, R1335L |
| M631L, R654L, R664K, R753G, I1057V, R1114G, Y1131C, D1135N, D1180G, G1218S, E1219V, Q1221H, P1249S, P1321S, D1332G, R1335L |

The above description of various napDNAbps which can be used in connection with the presently disclose base editors is not meant to be limiting in any way. The base editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 variants have a nickase activity, i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats). The base editors described herein may also comprise Cas9 equivalents, including Cas12a/Cpf1 and Cas12b proteins which are the result of convergent evolution. The napDNAbps used herein (e.g., SpCas9, Cas9 variant, or Cas9 equivalents) may also may also contain various modifications that alter/enhance their PAM specifities. Lastly, the application contemplates any Cas9. Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequences or a reference Cas9 equivalent (e.g., CasI2a/Cpf1).

In a particular embodiment, the Cas9 variant having expanded PAM capabilities is SpCas9 (H840A) VRQR, having the following amino acid sequence (with the V, R, Q, R substitutions relative to the SpCas9 (H840A) of SEQ ID NO: 97 show in bold underline. In addition, the methionine residue in SpCas9 (H840) was removed for SpCas9 (H840A) VRQR) ("SpCas9-VRQR"). This SpCas9 variant possesses an altered PAM-specificity which recognizes a PAM of 5'-NGA-3' instead of the canonical PAM of 5'-NGG-3':

```
SpCas9-VRQR
                                                               (SEQ ID NO: 97)
DKKYSIGLDIGTNSVGWAVITDEYKVPSKKFKVLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITKAPLSASMIKRYDEHHQDLT

LLKALVRQQLPEKYKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGASAQSFIERMINFD

KNLPNEKVLPKHSLLYEYFTVYNELTKVKYVTEGMRKPAFLSGEQKKAIVDLLFKTNRKVTVKQLKEDYFKKIECFDSVEISG

VEDRFNASLGTYHDLLKIIKDKDELDNEENEDILEDIVLTLILFEDREMIEERLKTYAHLEDDKVMKQLKRRRYTGWGRLSRK

LINGIRDKQSGKTILDELKSDGFANRNEMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYLQNGRDMYVDQELDIN

RLSDYDVDAIVPQSFLKDDSIDNKVLIRSDKNRGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSDERKDFQFYKVREINNYHHAHDAYLNAVVGTAL

IKKYPKLESEFVYGDYKVYDVRKMIAKSEQEIGKATAKYFFYSNIMNFFKTEITLANGEIRKRPLIEINGETGEIVWDKGRDF
```

-continued

ATVRKVLSMPQVNIVKKTEVQTGGFSKESILPKRNSDKLIARKKDWDPKKYGGFVSPTVAYSVLVVAKVEKGKSKKLKSVKEL

LGITIMERSSFEKNPIDFLEAKGYKEVKKDLIIKLPKYSLFELENGRKRMLASARELQKGNELALPSKYVNFLYLASHYEKLK

GSPEDNEQKQLFVEQHKHYLDEIIEQISEFSKRVILADANLDKVLSAYNKHRDKPIREQAENIIHLFTLINLGAPAAFKYEDT

TIDRKQYRSTKEVLDATLIHQSITGLYETRIDLSQLGGD

In another particular embodiment, the Cas9 variant having expanded PAM capabilities is SpCas9 (H840A) VQR, having the following amino acid sequence (with the V, Q. R substitutions relative to the SpCas9 (H840A) of SEQ ID NO: 98 show in bold underline. In addition, the methionine residue in SpCas9 (H840) was removed for SpCas9 (H840A) VRQR) ("SpCas9-VQR"). This SpCas9 variant possesses an altered PAM-specificity which recognizes a PAM of 5'-NGA-3' instead of the canonical PAM of 5'-NGG-3':

SpCas9-VQR (SEQ ID NO: 98)

DKKYSIGLDIGTNSVGWAVITDEYKVPSKKFKVLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITKAPLSASMIKRYDEHHQDLT

LLKALVRQQLPEKYKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMIRKSEETITPWNFEEVVDKGASAQSFIERMINFD

KNLPNEKVLPKHSLLYEYFTVYNELTKVKYVTEGMRKPAFLSGEQKKAIVDLLFKTNRKVTVKQLKEDYFKKIECFDSVEISG

VEDRFNASLGTYHDLLKIIKDKDELDNEENEDILEDIVLTLILFEDREMIEERLKTYAHLEDDKVMKQLKRRRYTGWGRLSRK

LINGIRDKQSGKTILDFLKSDGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYLQNGRDMYVDQELDIN

RLSDYDVDAIVPQSFLKDDSIDNKVLTRSDKNRGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSDFRKDFQFYKVREINNYHHAHDAYLNAVVGTAL

IKKYPKLESEFVYGDYKVYDVRKMIAKSEQEIGKATAKYFFYSNIMNFFKTEITLANGEIRKRPLIEINGETGEIVWDKGRDF

ATVRKVLSMPQVNIVKKTEVQTGGFSKESILPKRNSDKLIARKKDWDPKKYGGFVSPTVAYSVLVVAKVEKGKSKKLKSVKEL

LGITIMERSSFEKNPIDFLEAKGYKEVKKDLIIKLPKYSLFELENGRKRMLASAGELQKGNELALPSKYVNFLYLASHYEKLK

GSPEDNEQKQLFVEQHKHYLDEIIEQISEFSKRVILADANLDKVLSAYNKHRDKPIREQAENIIHLFTLTNLGAPAAFKYFDT

TIDRKQYRSTKEVLDATLIHQSITGLYETRIDLSQLGGD

In another particular embodiment, the Cas9 variant having expanded PAM capabilities is SpCas9 (H840A) VRER, having the following amino acid sequence (with the V, R, E, R substitutions relative to the SpCas9 (H840A) of SEQ ID NO: 99 are shown in bold underline. In addition, the methionine residue in SpCas9 (H840) was removed for SpCas9 (H840A) VRER) ("SpCas9-VRER"). This SpCas9 variant possesses an altered PAM-specificity which recognizes a PAM of 5'-NGCG-3' instead of the canonical PAM of 5'-NGG-3':

SpCas9-VRER (SEQ ID NO: 99)

DKKYSIGLDIGTNSVGWAVITDEYKVPSKKFKVLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITKAPLSASMIKRYDEHHQDLT

LLKALVRQQLPEKYKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIVDLLFKTNRKVTVKQLKEDYFKKIECFDSVEISG

-continued

VEDRFNASLGTYHDLLKIIKDKDELDNEENEDILEDIVLTLTLFEDREMIEERLKTYAHLEDDKVMKQLKRRRYTGWGRLSRK

LINGIRDKQSGKTILDFLKSDGFANRNEMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYLQNGRDMYVDQELDIN

RLSDYDVDAIVPQSFLKDDSIDNKVLTRSDKNRGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSDERKDFQFYKVREINNYHHAHDAYLNAVVGTAL

IKKYPKLESEFVYGDYKVYDVRKMIAKSEQEIGKATAKYFFYSNIMNFFKTEITLANGEIRKRPLIEINGETGEIVWDKGRDF

ATVRKVLSMPQVNIVKKTEVQTGGFSKESILPKRNSDKLIARKKDWDPKKYGGFVSPTVAYSVLVVAKVEKGKSKKLKSVKEL

LGITIMERSSFEKNPIDFLEAKGYKEVKKDLIIKLPKYSLFELENGRKRMLASARELQKGNELALPSKYVNFLYLASHYEKLK

GSPEDNEQKQLFVEQHKHYLDEIIEQISEFSKRVILADANLDKVLSAYNKHRDKPIREQAENIIHLETLTNLGAPAAFKYFDT

TIDRKEYRSTKEVLDATLIHQSITGLYETRIDLSQLGGD

In yet particular embodiment, the Cas9 variant having expanded PAM capabilities is SpCas9-NG, as reported in Nishimasu et al., "Engineered CRISPR-Cas9 nuclease with expanded targeting space," Science, 2018, 361: 1259-1262, which is incorporated herein by reference. SpCas9-NG (VRVRFRR), having the following amino acid sequence substitutions: R1335V, Li IIR. D 1135V, G1218R, E1219F, A 1322R, and T1337R relative to the canonical SpCas9 sequence (SEQ ID NO: 28. This SpCas9 has a relaxed PAM specificity, i.e., with activity on a PAM of NGH (wherein H=A, T, or C). See Nishimasu et al., "Engineered CRISPR-Cas9 nuclease with expanded targeting space," Science, 2018, 361: 1259-1262, which is incorporated herein by reference.

SpCas9-NG (SEQ ID NO: 100)

MDKKYSIGLDIGTNSVGWAVITDEYKVPSKKFKVLGNTDRHSIKKNLIGALLFDSGETAEATRLKRTARRRYTRRKNRICYLQ

EIFSNEMAKVDDSFFHRLEESFLVEEDKKHERHPIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTFDNGSIPHQIH

LGELHAILRRQEDFYPFLKDNREKIEKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFKTNRKVTVKQLKEDYFKKIECFDSVEIS

GVEDRFNASLGTYHDLLKIIKDKDELDNEENEDILEDIVLTLILFEDREMIEERLKTYAHLEDDKVMKQLKRRRYTGWGRLSR

KLINGIRDKQSGKTILDFLKSDGFANRNEMQLIHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDERKDFQFYKVREINNYHHAHDAYLNAVVGTA

LIKKYPKLESEFVYGDYKVYDVRKMIAKSEQEIGKATAKYFFYSNIMNFFKTEITLANGEIRKRPLIEINGETGEIVWDKGRD

FATVRKVLSMPQVNIVKKTEVQTGGFSKESIRPKRNSDKLIARKKDWDPKKYGGFVSPTVAYSVLVVAKVEKGKSKKLKSVKE

LLGITIMERSSFEKNPIDFLEAKGYKEVKKDLIIKLPKYSLFELENGRKRMLASARFLQKGNELALPSKYVNFLYLASHYEKL

KGSPEDNEQKQLFVEQHKHYLDEIIEQISEFSKRVILADANLDKVLSAYNKHRDKPIREQAENIIHLFTLINLGAPRAFKYFD

TTIDRKVYRSTKEVLDATLIHQSITGLYETRIDLSQLGGD

In addition, any available methods may be utilized to obtain or construct a variant or mutant Cas9 protein. The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook. Molecular Cloning: A Laboratory Manual (4th ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Because of their nature, gain-of-function mutations are usually dominant.

Mutations can be introduced into a reference Cas9 protein using site-directed mutagenesis. Older methods of site-directed mutagenesis known in the art rely on sub-cloning of the sequence to be mutated into a vector, such as an M13 bacteriophage vector, that allows the isolation of single-stranded DNA template. In these methods, one anneals a mutagenic primer (i.e., a primer capable of annealing to the site to be mutated but bearing one or more mismatched nucleotides at the site to be mutated) to the single-stranded template and then polymerizes the complement of the template starting from the 3' end of the mutagenic primer. The resulting duplexes are then transformed into host bacteria and plaques are screened for the desired mutation. More recently, site-directed mutagenesis has employed PCR methodologies, which have the advantage of not requiring a single-stranded template. In addition, methods have been developed that do not require sub-cloning. Several issues must be considered when PCR-based site-directed mutagenesis is performed. First, in these methods it is desirable to reduce the number of PCR cycles to prevent expansion of undesired mutations introduced by the polymerase. Second, a selection must be employed in order to reduce the number of non-mutated parental molecules persisting in the reaction. Third, an extended-length PCR method is preferred in order to allow the use of a single PCR primer set. And fourth, because of the non-template-dependent terminal extension activity of some thermostable polymerases it is often necessary to incorporate an end-polishing step into the procedure prior to blunt-end ligation of the PCR-generated mutant product.

Mutations may also be introduced by directed evolution processes, such as phage-assisted continuous evolution (PACE) or phage-assisted noncontinuous evolution (PANCE). The term "phage-assisted continuous evolution (PACE)," as used herein, refers to continuous evolution that employs phage as viral vectors. The general concept of PACE technology has been described, for example, in International PCT Application. PCT/US2009/056194, filed Sep. 8, 2009, published as WO 2010/028347 on Mar. 11, 2010; International PCT Application. PCT/US2011/066747, filed Dec. 22, 2011, published as WO 2012/088381 on Jun. 28, 2012; U.S. Application, U.S. Pat. No. 9,023,594, issued May 5. 2015, International PCT Application, PCT/US2015/012022, filed Jan. 20, 2015, published as WO 2015/134121 on Sep. 11, 2015, and International PCT Application, PCT/US2016/027795, filed Apr. 15. 2016, published as WO 2016/168631 on Oct. 20, 2016, the entire contents of each of which are incorporated herein by reference. Variant Cas9s may also be obtain by phage-assisted non-continuous evolution (PANCE)," which as used herein, refers to non-continuous evolution that employs phage as viral vectors. PANCE is a simplified technique for rapid in vivo directed evolution using serial flask transfers of evolving 'selection phage' (SP), which contain a gene of interest to be evolved, across fresh *E. coli* host cells, thereby allowing genes inside the host *E. coli* to be held constant while genes contained in the SP continuously evolve. Serial flask transfers have long served as a widely-accessible approach for laboratory evolution of microbes, and, more recently, analogous approaches have been developed for bacteriophage evolution. The PANCE system features lower stringency than the PACE system.

Any of the references noted above which relate to Cas9 or Cas9 equivalents are hereby incorporated by reference in their entireties, if not already stated so.

Linkers

In certain embodiments, linkers may be used to link any of the peptides or peptide domains or moieties of the invention (e.g., a mitoTALE fused to a DddA).

As defined above, the term "linker," as used herein, refers to a chemical group or a molecule linking two molecules or moieties (e.g., a binding domain (e.g., mitoTALE) and a editing domain (e.g., DddA, or portion thereof)). In some embodiments, a linker joins a binding domain (e.g., mitoTALE) and a catalytic domain (e.g., DddA, or portion thereof). In some embodiments, a linker joins a mitoTALE and DddA. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 1-100 amino acids in length, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer linkers are also contemplated.

The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid. 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some other embodiments, the linker comprises the amino acid sequence is greater than one amino acid residues in length. In some embodiments, the linker comprises less than six amino acid in length. In some embodiments, the linker is two amino acid residues in length. In some embodiments, the linker comprises the amino acid sequence of any one of SEQ ID NOs.: 101-117.

In certain embodiments, linkers may be used to link any of the protein or protein domains described herein (e.g., a deaminase domain and a Cas9 domain). The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid. 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35-40, 40-45, 45-50, 50-60, 60-70. 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 101), which may also be referred to as the XTEN linker. In some embodiments, the linker is 32 amino acids in length. In some embodiments, the linker comprises the amino acid sequence $(SGGS)_2$-SGSETPGTSESATPES-$(SGGS)_2$ (SEQ ID NO: 102), which may also be referred to as $(SGGS)_2$-XTEN-$(SGGS)_2$ (SEQ ID NO: 102). In some embodiments, the linker comprises the amino acid sequence, wherein n is 0, 1, 2, 3, 4, 5, 6, 7, 8, 9, or 10. In some embodiments, a linker comprises the amino acid sequence SGGS (SEQ ID NO: 104). In some embodiments, a linker comprises $(SGGS)_n$ (SEQ ID NO: 104), $(GGGS)_n$ (SEQ ID NO: 105), $(GGGGS)_n$ (SEQ ID NO: 106), $(G)_n$ (SEQ ID NO: 107). $(EAAAK)_n$ (SEQ ID NO: 108), $(SGGS)_n$-SGSETPGTSESATPES-$(SGGS)_n$ (SEQ ID NO: 109), $(GGS)_n$ (SEQ ID NO: 110), SGSETPGTSESATPES (SEQ ID NO: 101), or $(XP)_n$ (SEQ ID NO: 111) motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 101), and SGGS (SEQ ID NO: 104). In some embodiments, a linker comprises SGGSSGSETPGTSESATPESSGGS (SEQ ID NO: 109). In some embodiments, a linker comprises SGGSSGGSSGSETPGTSESATPESSGGSSGGS (SEQ ID NO: 112). In some embodiments, a linker comprises GGSGGSPGSPAGSPTSTEEGTSESATPESGPGT-STEPSEGSAPGSPAGSPTSTEEGTSTEPS EGSAPGT-STEPSEGSAPGTSESATPESGPGSEPATSGGSGGS (SEQ ID NO: 113). In some embodiments, the linker is 24 amino acids in length. In some embodiments, the linker comprises the amino acid sequence SGGSSGGSSGSETPGTSESAT-PES (SEQ ID NO: 114). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 115). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESAT-PESSGGSSG GS (SEQ ID NO: 116). In some embodiments, the linker is 92 amino acids in length. In some embodiments, the linker comprises the amino acid sequence PGSPAGSPTSTEEGTSESATPESGPGT-STEPSEGSAPGSPAGSPTSTEEGTSTEPSEGSAPG TSTEPSEGSAPGTSESATPESGPGSEPATS (SEQ ID NO: 117). It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine or a cytidine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase), a nucleic acid programmable DNA binding protein (napDNAbp). Various linker lengths and flexibilities between an adenosine deaminase (e.g., an engineered ecTadA) and a napDNAbp (e.g., a Cas9 domain), and/or between a first adenosine deaminase and a second adenosine deaminase can be employed (e.g., ranging from very flexible linkers of the form $(GGGGS)_n$ (SEQ ID NO: 106), $(GGGGS)_n$ (SEQ ID NO: 106), and $(G)_n$ (SEQ ID NO: 107) to more rigid linkers of the form $(EAAAK)_n$ (SEQ ID NO: 108), $(SGGS)_n$ (SEQ ID NO: 104), SGSETPGTSESATPES (SEQ ID NO: 101) (see, e.g., Guilinger J P. Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$ (SEQ ID NO: 111)) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a $(GGS)_n$ (SEQ ID NO: 110) motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising the amino acid sequence SGSETPGTSESATPES (SEQ ID NO: 101), SGGS (SEQ ID NO: 104), SGGSSGSETPGTSESATPESSGGS (SEQ ID NO: 109), SGGSSGGSSGSETPGTSESATPESSGGSSGGS (SEQ ID NO: 102), or GGSGGSPGSPAGSPTSTEEGTSESATPESGPGTSTEPSEGSAPGSPAGSPTSTEEGTSTEPS EGSAPGTSTEPSEGSAPGTSESATPESGPGSEPATSGGSGGS (SEQ ID NO: 113). In some embodiments, the linker is 24 amino acids in length. In some embodiments, the linker comprises the amino acid sequence SGGSSGGSSGSETPGTSESATPES (SEQ ID NO: 114). In some embodiments, the linker is 32 amino acids in length. In some embodiments, the linker is 32 amino acids in length. In some embodiments, the linker comprises the amino acid sequence $(SGGS)_2$—SGSETPGTSESATPES-$(SGGS)_2$ (SEQ ID NO: 102), which may also be referred to as $(SGGS)_2$—XTEN-$(SGGS)_2$ (SEQ ID NO: 102). In some embodiments, the linker comprises the amino acid sequence, wherein n is 0, 1, 2, 3, 4, 5, 6, 7, 8, 9, or 10. In some embodiments, the linker is 40 amino acids in length. In some embodiments, the linker comprises the amino acid sequence SGGSSGGSSGSETPGTSESATPESSGGSSGGSSGGSSGGS (SEQ ID NO: 115). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGSSG GS (SEQ ID NO: 116). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAPG TSTEPSEGSAPGTSESATPESGPGSEPATS (SEQ ID NO: 117).

Uracil Glycosylase Inhibitor (UGI)

In some embodiments, the fusion proteins of the disclosure comprises a UGI. When the DddA enzyme is employed and deaminates the target nucleotide, it may trigger uracil repair activity in the cell, thereby causing excision of the deaminated nucleotide. This may cause degredation of the nucleic acid or otherwise inhibit the effect of the correction or nucleotide alteration induced by the fusion protein. To inhibit this activity, a UGI may be desired. In some embodiments, the first and/or second fusion protein comprises more than one UGI. In some embodiments, the first and/or second fusion protein comprises two UGIs. In some embodiments, the first and/or second fusion protein contains two UGIs. The UGI or multiple UGIs may be appended or attached to any portion of the fusion protein. In some embodiments, the UGI is attached to the first or second portion of a DddA in the first or second fusion protein. In some embodiments, a second UGI is attached to the first UGI which is attached to the first or second portion of a DddA in the first or second fusion protein.

In other embodiments, the base editors described herein may comprise one or more uracil glycosylase inhibitors. The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 118. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 118. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 118. In some embodiments, a UGI comprises an amino acid sequence homologous to the amino acid sequence set forth in SEQ ID NO: 118, or an amino acid sequence homologous to a fragment of the amino acid sequence set forth in SEQ ID NO: 118. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 118. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 118. In some embodiments, the UGI comprises the following amino acid sequence:

Uracil-DNA glycosylase inhibitor:

```
>sp|P14739|UNGI_BPPB2
                                        (SEQ ID NO: 118)
MTNLSDIIEKETGKQLVIQESILMLPEEVEEVIGNKPESDILVHTAYDE
STDENVMLLTSDAPEYKPWALVIQDSNGENKIKML.
```

The base editors described herein may comprise more than one UGI domain, which may be separated by one or more linkers as described herein. It will also be understood that in the context of the herein disclosed base editors, the UGI domain may be linked to a deaminase domain.

In some embodiments, a UGI is absent from a base editor. In some embodiments, where a base editor comprises a ZFP or mitoZFP. UGIs are removed or are absent from the base editor. In some embodiments, the removal and/or absence of UGIs increases the activity of a DddA.

NLS Domains

In various embodiments, the fusion proteins may comprise one or more nuclear localization sequences (NLS), which help promote translocation of a protein into the cell nucleus. Such sequences are well-known in the art and can include the following examples:

| DESCRIPTION | SEQUENCE | SEQUENCE IDENTIFIER |
|---|---|---|
| NLS OF SV40 LARGE T-AG | PKKKRKV | 119 |
| NLS OF POLYOMA LARGE T-AG | VSRKRPRP | 120 |

-continued

| DESCRIPTION | SEQUENCE | SEQUENCE IDENTIFIER |
|---|---|---|
| NLS OF C-MYC | PAAKRVKLD | 121 |
| NLS OF TUS-PROTEIN | KLKIKRPVK | 122 |
| NLS OF HEPATITIS D VIRUS ANTIGEN | EGAPPAKRAR | 123 |
| NLS OF MURINE P53 | PPQPKKKPLDGE | 124 |
| NLS | MKRTADGSEFESPKKKRKV | 125 |
| NLS OF NUCLEOPLASMIN | AVKRPAATKKAGQAKKKKLD | 126 |
| NLS OF PE1 AND PE2 | SGGSKRTADGSEFEPKKKRKV | 127 |
| NLS OF EGL-13 | MSRRRKANPTKLSENAKKLAKEVEN | 128 |
| NLS | MDSLLMNRRKFLYQFKNVRWAKGRRETYLC | 129 |

The NLS examples above are non-limiting. The PE fusion proteins may comprise any known NLS sequence, including any of those described in Cokol et al., "Finding nuclear localization signals," *EMBO Rep.,* 2000. 1(5): 411-415 and Freitas et al., "Mechanisms and Signals for the Nuclear Import of Proteins." *Current Genomics,* 2009, 10(8): 550-7, each of which are incorporated herein by reference.

Split-Intein Domains

It will be understood that in some embodiments (e.g., delivery of a base editor in vivo using AAV particles), it may be advantageous to split a polypeptide (e.g., a deaminase or a napDNAbp) or a fusion protein (e.g., a base editor) into an N-terminal half and a C-terminal half, delivery them separately, and then allow their colocalization to reform the complete protein (or fusion protein as the case may be) within the cell. Separate halves of a protein or a fusion protein may each comprise a split-intein tag to facilitate the reformation of the complete protein or fusion protein by the mechanism of protein trans splicing.

Protein trans-splicing, catalyzed by split inteins, provides an entirely enzymatic method for protein ligation. A split-intein is essentially a contiguous intein (e.g. a mini-intein) split into two pieces named N-intein and C-intein, respectively. The N-intein and C-intein of a split intein can associate non-covalently to form an active intein and catalyze the splicing reaction essentially in same way as a contiguous intein does. Split inteins have been found in nature and also engineered in laboratories. As used herein, the term "split intein" refers to any intein in which one or more peptide bond breaks exists between the N-terminal and C-terminal amino acid sequences such that the N-terminal and C-terminal sequences become separate molecules that can non-covalently reassociate, or reconstitute, into an intein that is functional for trans-splicing reactions. Any catalytically active intein, or fragment thereof, may be used to derive a split intein for use in the methods of the invention. For example, in one aspect the split intein may be derived from a eukaryotic intein. In another aspect, the split intein may be derived from a bacterial intein. In another aspect, the split intein may be derived from an archaeal intein. Preferably, the split intein so-derived will possess only the amino acid sequences essential for catalyzing trans-splicing reactions.

As used herein, the "N-terminal split intein (In)" refers to any intein sequence that comprises an N-terminal amino acid sequence that is functional for trans-splicing reactions. An In thus also comprises a sequence that is spliced out when trans-splicing occurs. An In can comprise a sequence that is a modification of the N-terminal portion of a naturally occurring intein sequence. For example, an In can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the In.

As used herein, the "C-terminal split intein (Ic)" refers to any intein sequence that comprises a C-terminal amino acid sequence that is functional for trans-splicing reactions. In one aspect, the Ic comprises 4 to 7 contiguous amino acid residues, at least 4 amino acids of which are from the last β-strand of the intein from which it was derived. An Ic thus also comprises a sequence that is spliced out when trans-splicing occurs. An Ic can comprise a sequence that is a modification of the C-terminal portion of a naturally occurring intein sequence. For example, an Ic can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the Ic.

In some embodiments of the invention, a peptide linked to an Ic or an In can comprise an additional chemical moiety including, among others, fluorescence groups, biotin, polyethylene glycol (PEG), amino acid analogs, unnatural amino acids, phosphate groups, glycosyl groups, radioisotope labels, and pharmaceutical molecules. In other embodiments, a peptide linked to an Ic can comprise one or more chemically reactive groups including, among others, ketone, aldehyde, Cys residues and Lys residues. The N-intein and C-intein of a split intein can associate non-covalently to form an active intein and catalyze the splicing reaction when an "intein-splicing polypeptide (ISP)" is present. As used herein. "intein-splicing polypeptide (ISP)" refers to the portion of the amino acid sequence of a split intein that remains when the Ic, In, or both, are removed from the split intein. In certain embodiments, the In comprises the ISP. In another embodiment, the Ic comprises the ISP. In yet another embodiment, the ISP is a separate peptide that is not covalently linked to In nor to Ic.

Split inteins may be created from contiguous inteins by engineering one or more split sites in the unstructured loop or intervening amino acid sequence between the ~12 conserved beta-strands found in the structure of mini-inteins. Some flexibility in the position of the split site within regions between the beta-strands may exist, provided that creation of the split will not disrupt the structure of the intein, the structured beta-strands in particular, to a sufficient degree that protein splicing activity is lost.

In protein trans-splicing, one precursor protein consists of an N-extein part followed by the N-intein, another precursor protein consists of the C-intein followed by a C-extein part, and a trans-splicing reaction (catalyzed by the N- and C-inteins together) excises the two intein sequences and links the two extein sequences with a peptide bond. Protein trans-splicing, being an enzymatic reaction, can work with very low (e.g. micromolar) concentrations of proteins and can be carried out under physiological conditions.

RNA-Protein Recruitment System

In various embodiments, two separate protein domains (e.g., a Cas9 domain and a double-stranded deaminase domain) may be colocalized to one another to form a functional complex (akin to the function of a fusion protein comprising the two separate protein domains) by using an "RNA-protein recruitment system," such as the "MS2 tagging technique." Such systems generally tag one protein domain with an "RNA-protein interaction domain" (aka "RNA-protein recruitment domain") and the other with an "RNA-binding protein" that specifically recognizes and binds to the RNA-protein interaction domain, e.g., a specific hairpin structure. These types of systems can be leveraged to colocalize the domains of a base editor, as well as to recruitment additional functionalities to a base editor, such as a UGI domain. In one example, the MS2 tagging technique is based on the natural interaction of the MS2 bacteriophage coat protein ("MCP" or "MS2cp") with a stem-loop or hairpin structure present in the genome of the phage, i.e., the "MS2 hairpin." In the case of the MS2 hairpin, it is recognized and bound by the MS2 bacteriophage coat protein (MCP). Thus, in one exemplarly scenario a deaminase-MS2 fusion can recruit a Cas9-MCP fusion.

A review of other modular RNA-protein interaction domains are described in the art, for example, in Johansson et al., "RNA recognition by the MS2 phage coat protein," *Sem Virol.,* 1997, Vol. 8(3): 176-185: Delebecque et al., "Organization of intracellular reactions with rationally designed RNA assemblies." *Science.* 2011, Vol. 333: 470-474; Mali et al., "Cas9 transcriptional activators for target specificity screening and paired nickases for cooperative genome engineering," *Nat. Biotechnol.,* 2013, Vol. 31: 833-838; and Zalatan et al., "Engineering complex synthetic transcriptional programs with CRISPR RNA scaffolds," *Cell,* 2015, Vol. 160: 339-350, each of which are incorporated herein by reference in their entireties. Other systems include the PP7 hairpin, which specifically recruits the PCP protein, and the "com" hairpin, which specifically recruits the Corn protein. See Zalatan et al.

The nucleotide sequence of the MS2 hairpin (or equivalently referred to as the "MS2 aptamer") is: GCCAACATGAGGATCACCCATGTCTGCAGGGCC (SEQ ID NO: 25).

The amino acid sequence of the MCP or MS2cp is:

```
                                    (SEQ ID NO: 26)
GSASNFTQFVLVDNGGTGDVTVAPSNFANGVAEWISSNSRSQAYKVTCSV

RQSSAQNRKYTIKVEVPKVATQTVGGEELPVAGWRSYLNMELTIPIFATN

SDCELIVKAMQGLLKDGNPIPSAIAANSGIY.
```

Delivery

In another aspect, the present disclosure provides for the delivery of fusion proteins in vitro and in vivo using split DddA protein formulations. The presently disclosed methods for delivering fusion proteins via various methods. For example, DddA proteins have exhibited toxic effects in vivo, and so require special solutions. One such solution is formulating the DddA, and fusion protein thereof, split into pairs that are packaged into two separate rAAV particles that, when co-delivered to a cell, reconstitute the functional DddA protein. Several other special considerations to account for the unique features of fusion protein are described, including the optimization of split sites. Mito-TALE-DddA and/or mitoZF-DddA and/or Cas9-DddA fusion proteins. mRNA expressing the fusion proteins, or DNA can be packaged into lipid nanoparticles, rAAV, or lentivirus and injected, ingested, or inhaled to alter genomic DNA in vivo and ex vivo, including for the purposes of establishing animal models of human disease, testing therapeutic and scientific hypotheses in animal models of human disease, and treating disease in humans.

In another aspect, the present disclosure provides for the delivery of base editors in vitro and in vivo using various strategies, including on separate vectors using split inteins and as well as direct delivery strategies of the ribonucleoprotein complex (i.e., the base editor complexed to the gRNA and/or the second-site gRNA) using techniques such as electroporation, use of cationic lipid-mediated formulations, and induced endocytosis methods using receptor ligands fused to the ribonucleoprotein complexes. Any such methods are contemplated herein.

In some aspects, the invention provides methods comprising delivering one or more base editor-encoding polynucleotides, such as or one or more vectors as described herein encoding one or more components of the base editing system described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a base editor as described herein in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a base editor to cells in culture, or in a host organism. Non-viral vector delivery systems include DNA plasmids. RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson. Science 256:808-813 (1992); Nabel & Feigner, TIBTECH 11:211-217 (1993): Mitani & Caskey, TIBTECH 11:162-166 (1993); Dillon, TIBTECH 11:167-175 (1993); Miller, Nature 357:455-460 (1992); Van Brunt. Biotechnology 6(10):1149-1154 (1988): Vigne, Restorative Neurology and Neuroscience 8:35-36 (1995): Kremer & Perricaudet, British Medical Bulletin 51(1):31-44 (1995); Haddada et al., in Current Topics in Microbiology and Immunology Doerfler and Bihm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see. e.g., Crystal, Science 270:404-410 (1995); Blaese et al., Cancer Gene Ther. 2:291-297 (1995); Behr et al., Bioconjugate Chem. 5:382-389 (1994): Remy et al., Bioconjugate Chem. 5:647-654 (1994): Gao et al., Gene Therapy 2:710-722 (1995); Ahmad et al., Cancer Res. 52:4817-4820 (1992): U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see. e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see. e.g., West et al., Virology 160:38-47 (1987): U.S. Pat. No. 4,797,368; WO 93/24641: Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka. PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In various embodiments, the base editor constructs (including, the split-constructs) may be engineered for delivery in one or more rAAV vectors. An rAAV as related to any of the methods and compositions provided herein may be of any serotype including any derivative or pseudotype (e.g., 1, 2, 3, 4, 5, 6, 7, 8, 9, 10, 11, 12, 13, 2/1, 2/5, 2/8, 2/9, 3/1, 3/5, 3/8, or 3/9). An rAAV may comprise a genetic load (i.e., a recombinant nucleic acid vector that expresses a gene of interest, such as a whole or split base editor fusion protein that is carried by the rAAV into a cell) that is to be delivered to a cell. An rAAV may be chimeric.

As used herein, the serotype of an rAAV refers to the serotype of the capsid proteins of the recombinant virus. Non-limiting examples of derivatives and pseudotypes include rAAV2/1, rAAV2/5, rAAV2/8, rAAV2/9, AAV2-AAV3 hybrid, AAVrh.10, AAVhu.14, AAV3a/3b, AAVrh32.33, AAV-HSC15, AAV-HSC17, AAVhu.37, AAVrh.8, CHt-P6, AAV2.5, AAV6.2, AAV2i8, AAV-HSC15/17, AAVM41, AAV9.45, AAV6(Y445F/Y731F), AAV2.5T, AAV-HAEl/2, AAV clone 32/83, AAVShH10, AAV2 (Y→F), AAV8 (Y733F), AAV2.15, AAV2.4, AAVM41, and AAVr3.45. A non-limiting example of derivatives and pseudotypes that have chimeric VP1 proteins is rAAV2/5-1VP1u, which has the genome of AAV2, capsid backbone of AAV5 and VP1u of AAV1. Other non-limiting example of derivatives and pseudotypes that have chimeric VP1 proteins are rAAV2/5-8VP1u, rAAV2/9-1VP1u, and rAAV2/9-8VP1u.

AAV derivatives/pseudotypes, and methods of producing such derivatives/pseudotypes are known in the art (see, e.g., Mol Ther. 2012 April; 20(4):699-708. doi: 10.1038/mt.2011.287. Epub 2012 Jan. 24. The AAV vector toolkit: poised at the clinical crossroads. Asokan A1, Schaffer D V. Samulski R J.). Methods for producing and using pseudotyped rAAV vectors are known in the art (see, e.g., Duan et al., J. Virol., 75:7662-7671, 2001; Halbert et al., J. Virol., 74:1524-1532. 2000: Zolotukhin et al., Methods, 28:158-167, 2002; and Auricchio et al., Hum. Molec. Genet., 10:3075-3081, 2001).

Methods of making or packaging rAAV particles are known in the art and reagents are commercially available (see, e.g., Zolotukhin et al. Production and purification of serotype 1, 2, and 5 recombinant adeno-associated viral vectors. Methods 28 (2002) 158-167; and U.S. Patent Publication Numbers US20070015238 and US20120322861, which are incorporated herein by reference; and plasmids and kits available from ATCC and Cell Biolabs, Inc.). For example, a plasmid comprising a gene of interest may be combined with one or more helper plasmids, e.g., that contain a rep gene (e.g., encoding Rep78, Rep68, Rep52 and Rep40) and a cap gene (encoding VP1, VP2, and VP3, including a modified VP2 region as described herein), and transfected into a recombinant cells such that the rAAV particle can be packaged and subsequently purified.

Recombinant AAV may comprise a nucleic acid vector, which may comprise at a minimum: (a) one or more heterologous nucleic acid regions comprising a sequence encoding a protein or polypeptide of interest or an RNA of interest (e.g., a siRNA or microRNA), and (b) one or more regions comprising inverted terminal repeat (ITR) sequences (e.g., wild-type ITR sequences or engineered ITR sequences) flanking the one or more nucleic acid regions (e.g., heterologous nucleic acid regions). Herein, heterologous nucleic acid regions comprising a sequence encoding a protein of interest or RNA of interest are referred to as genes of interest.

Any one of the rAAV particles provided herein may have capsid proteins that have amino acids of different serotypes outside of the VP1u region. In some embodiments, the serotype of the backbone of the VP1 protein is different from the serotype of the ITRs and/or the Rep gene. In some embodiments, the serotype of the backbone of the VP1 capsid protein of a particle is the same as the serotype of the ITRs. In some embodiments, the serotype of the backbone of the VP1 capsid protein of a particle is the same as the serotype of the Rep gene. In some embodiments, capsid proteins of rAAV particles comprise amino acid mutations that result in improved transduction efficiency.

In some embodiments, the nucleic acid vector comprises one or more regions comprising a sequence that facilitates expression of the nucleic acid (e.g., the heterologous nucleic acid), e.g., expression control sequences operatively linked to the nucleic acid. Numerous such sequences are known in the art. Non-limiting examples of expression control sequences include promoters, insulators, silencers, response elements, introns, enhancers, initiation sites, termination signals, and poly(A) tails. Any combination of such control sequences is contemplated herein (e.g., a promoter and an enhancer).

Final AAV constructs may incorporate a sequence encoding the gRNA. In other embodiments, the AAV constructs may incorporate a sequence encoding the second-site nicking guide RNA. In still other embodiments, the AAV constructs may incorporate a sequence encoding the second-site nicking guide RNA and a sequence encoding the gRNA.

In various embodiments, the gRNAs and the second-site nicking guide RNAs can be expressed from an appropriate promoter, such as a human U6 (hU6) promoter, a mouse U6 (mU6) promoter, or other appropriate promoter. The gRNAs and the second-site nicking guide RNAs can be driven by the same promoters or different promoters.

In some embodiments, a rAAV constructs or the herein compositions are administered to a subject enterally. In some embodiments, a rAAV constructs or the herein compositions are administered to the subject parenterally. In some embodiments, a rAAV particle or the herein compositions are administered to a subject subcutaneously, intraocularly, intravitreally, subretinally, intravenously (IV), intracerebroventricularly, intramuscularly, intrathecally (IT), intracisternally, intraperitoneally, via inhalation, topically, or by direct injection to one or more cells, tissues, or organs. In some embodiments, a rAAV particle or the herein compositions are administered to the subject by injection into the hepatic artery or portal vein.

In other aspects, the base editors can be divided at a split site and provided as two halves of a whole/complete base editor. The two halves can be delivered to cells (e.g., as expressed proteins or on separate expression vectors) and once in contact inside the cell, the two halves form the complete base editor through the self-splicing action of the inteins on each base editor half. Split intein sequences can be engineered into each of the halves of the encoded base editor to facilitate their transplicing inside the cell and the concomitant restoration of the complete, functioning base editor.

These split intein-based methods overcome several barriers to in vivo delivery. For example, the DNA encoding base editors is larger than the rAAV packaging limit, and so requires special solutions. One such solution is formulating the editor fused to split intein pairs that are packaged into two separate rAAV particles that, when co-delivered to a cell, reconstitute the functional editor protein. Several other special considerations to account for the unique features of prime editing are described, including the optimization of second-site nicking targets and properly packaging base editors into virus vectors, including lentiviruses and rAAV.

In this aspect, the base editors can be divided at a split site and provided as two halves of a whole/complete base editor. The two halves can be delivered to cells (e.g., as expressed proteins or on separate expression vectors) and once in contact inside the cell, the two halves form the complete base editor through the self-splicing action of the inteins on each base editor half. Split intein sequences can be engineered into each of the halves of the encoded base editor to facilitate their transplicing inside the cell and the concomitant restoration of the complete, functioning base editor.

In various embodiments, the base editors may be engineered as two half proteins (i.e., a BE N-terminal half and a BE C-terminal half) by "splitting" the whole base editor as a "split site." The "split site" refers to the location of insertion of split intein sequences (i.e., the N intein and the C intein) between two adjacent amino acid residues in the base editor. More specifically, the "split site" refers to the location of dividing the whole base editor into two separate halves, wherein in each halve is fused at the split site to either the N intein or the C intein motifs. The split site can be at any suitable location in the base editor fusion protein, but preferably the split site is located at a position that allows for the formation of two half proteins which are appropriately sized for delivery (e.g., by expression vector) and wherein the inteins, which are fused to each half protein at the split site termini, are available to sufficiently interact with one another when one half protein contacts the other half protein inside the cell.

In some embodiments, the split site is located in the napDNAbp domain. In other embodiments, the split site is located in the RT domain. In other embodiments, the split site is located in a linker that joins the napDNAbp domain and the RT domain.

In various embodiments, split site design requires finding sites to split and insert an N- and C-terminal intein that are both structurally permissive for purposes of packaging the two half base editor domains into two different AAV genomes. Additionally, intein residues necessary for trans splicing can be incorporated by mutating residues at the N terminus of the C terminal extein or inserting residues that will leave an intein "scar."

In various embodiments, using SpCas9 nickase (SEQ ID NO: 29, 1368 amino acids) as an example, the split can between any two amino acids between 1 and 1368. Preferred splits, however, will be located between the central region of the protein, e.g., from amino acids 50-1250, or from 100-1200, or from 150-1150, or from 200-1100, or from 250-1050, or from 300-1000, or from 350-950, or from 400-900, or from 450-850, or from 500-800, or from 550-750, or from 600-700 of SEQ ID NO: 29. In specific exemplary embodiments, the split site may be between 7401741, or 801/802, or 1010/1011, or 1041/1042. In other embodiments the split site may be between 1/2. 2/3, 3/4, 4/5, 5/6, 6/7, 7/8, 8/9, 9/10, 10/11, 12/13, 14/15, 15/16, 17/18, 19/20 . . . 50/51 . . . 100/101 . . . 200/201 . . . 300/301 . . . 400/401 . . . 500/501 . . . 600/601 . . .

700/701 . . . 800/801 . . . 900/901 . . . 1000/1001 . . . 1100/1101 . . . 1200/1201 . . . 1300/1301 . . . and 1367/1368, including all adjacent pairs of amino acid residues.

In various embodiments, the split intein sequences can be engineered by from the following intein sequences.

2-4 INTEIN:

(SEQ ID NO: 17)

CLAEGTRIFDPVTGTTHRIEDVVDGRKPIHVVAAAKDGTLLARPVVSWFDQGTRDVIGL

RIAGGAIVWATPDHKVLTEYGWRAAGELRKGDRVAGPGGSGNSLALSLTADQMVSAL

LDAEPPILYSEYDPTSPFSEASMMGLLTNLADRELVHMINWAKRVPGFVDLTLHDQAH

LLECAWLEILMIGLVWRSMEHPGKLLFAPNLLLDRNQGKCVEGMVEIFDMLLATSSRF

RMMNLQGEEFVCLKSIILLNSGVYTFLSSTLKSLEEKDHIHRALDKITDTLIHLMAKAGL

TLQQQHQRLAQLLLILSHIRHMSNKGMEHLYSMKYKNVVPLYDLLLEMLDAHRLHAG

GSGASRVQAFADALDDKFLHDMLAEELRYSVIREVLPTRRARTFDLEVEELHTLVAEG

VVVHNC 3-2 INTEIN (SEQ ID NO: 18)

CLAEGTRIFDPVTGTTHRIEDVVDGRKPIHVVAVAKDGTLLARPVVSWFDQGTRDVIGL

RIAGGAIVWATPDHKVLTEYGWRAAGELRKGDRVAGPGGSGNSLALSLTADQMVSAL

LDAEPPILYSEYDPTSPFSEASMMGLLTNLADRELVHMINWAKRVPGFVDLTLHDQAH

LLECAWLEILMIGLVWRSMEHPGKLLFAPNLLLDRNQGKCVEGMVEIFDMLLATSSRF

RMMNLQGEEFVCLKSIILLNSGVYTFLSSTLKSLEEKDHIHRALDKITDTLIHLMAKAGL

TLQQQHQRLAQLLLILSHIRHMSNKGMEHLYSMKYTNVVPLYDLLLEMLDAHRLHAG

GSGASRVQAFADALDDKFLHDMLAEELRYSVIREVLPTRRARTFDLEVEELHTLVAEG

VVVHNC

30R3-1 INTEIN (SEQ ID NO: 19)

CLAEGTRIFDPVTGTTHRIEDVVDGRKPIHVVAAAKDGTLLARPVVSWFDQGTRDVIGL

RIAGGATVWATPDHKVLTEYGWRAAGELRKGDRVAGPGGSGNSLALSLTADQMVSA

LLDAEPPIPYSEYDPTSPFSEASMMGLLTNLADRELVHMINWAKRVPGFVDLTLHDQA

HLLECAWLEILMIGLVWRSMEHPGKLLFAPNLLLDRNQGKCVEGMVEIFDMLLATSSR

FRMMNLQGEEFVCLKSIILLNSGVYTFLSSTLKSLEEKDHIHRALDKITDTLIHLMAKAG

LTLQQQHQRLAQLLLILSHIRHMSNKGMEHLYSMKYKNVVPLYDLLLEMLDAHRLHA

GGSGASRVQAFADALDDKFLHDMLAEGLRYSVIREVLPTRRARTFDLEVEELHTLVAE

GVVVHNC

30R3-2 INTEIN (SEQ ID NO: 20)

CLAEGTRIFDPVTGTTHRIEDVVDGRKPIHVVAAAKDGTLLARPVVSWFDQGTRDVIGL

RIAGGATVWATPDHKVLTEYGWRAAGELRKGDRVAGPGGSGNSLALSLTADQMVSA

LLDAEPPILYSEYDPTSPFSEASMMGLLTNLADRELVHMINWAKRVPGFVDLTLHDQA

HLLECAWLEILMIGLVWRSMEHPGKLLFAPNLLLDRNQGKCVEGMVEIFDMLLATSSR

FRMMNLQGEEFVCLKSIILLNSGVYTFLSSTLKSLEEKDHIHRALDKITDTLIHLMAKAG

-continued

LTLQQQHQRLAQLLLILSHIRHMSNKGMEHLYSMKYKNVVPLYDLLLEMLDAHRLHA

GGSGASRVQAFADALDDKFLHDMLAEELRYSVIREVLPTRRARTFDLEVEELHTLVAE

GVVVHNC

30R3-3 INTEIN (SEQ ID NO: 21)

CLAEGTRIFDPVTGTTHRIEDVVDGRKPIHVVAAAKDGTLLARPVVSWFDQGTRDVIGL

RIAGGATVWATPDHKVLTEYGWRAAGELRKGDRVAGPGGSGNSLALSLTADQMVSA

LLDAEPPIPYSEYDPTSPFSEASMMGLLTNLADRELVHMINWAKRVPGFVDLTLHDQA

HLLECAWLEILMIGLVWRSMEHPGKLLFAPNLLLDRNQGKCVEGMVEIFDMLLATSSR

FRMMNLQGEEFVCLKSIILLNSGVYTFLSSTLKSLEEKDHIHRALDKITDTLIHLMAKAG

LTLQQQHQRLAQLLLILSHIRHMSNKGMEHLYSMKYKNVVPLYDLLLEMLDAHRLHA

GGSGASRVQAFADALDDKFLHDMLAEELRYSVIREVLPTRRARTFDLEVEELHTLVAE

GVVVHNC

37R3-1 INTEIN ((SEQ ID NO: 22)

CLAEGTRIFDPVTGTTHRIEDVVDGRKPIHVVAAAKDGTLLARPVVSWFDQGTRDVIGL

RIAGGATVWATPDHKVLTEYGWRAAGELRKGDRVAGPGGSGNSLALSLTADQMVSA

LLDAEPPILYSEYNPTSPFSEASMMGLLTNLADRELVHMINWAKRVPGFVDLTLHDQA

HLLERAWLEILMIGLVWRSMEHPGKLLFAPNLLLDRNQGKCVEGMVEIFDMLLATSSR

FRMMNLQGEEFVCLKSIILLNSGVYTFLSSTLKSLEEKDHIHRALDKITDTLIHLMAKAG

LTLQQQHQRLAQLLLILSHIRHMSNKGMEHLYSMKYKNVVPLYDLLLEMLDAHRLHA

GGSGASRVQAFADALDDKFLHDMLAEGLRYSVIREVLPTRRARTFDLEVEELHTLVAE

GVVVHNC

37R3-2 INTEIN (SEQ ID NO: 23)

CLAEGTRIFDPVTGTTHRIEDVVDGRKPIHVVAAAKDGTLLARPVVSWFDQGTRDVIGL

RIAGGAIVWATPDHKVLTEYGWRAAGELRKGDRVAGPGGSGNSLALSLTADQMVSAL

LDAEPPILYSEYDPTSPFSEASMMGLLTNLADRELVHMINWAKRVPGFVDLTLHDQAH

LLERAWLEILMIGLVWRSMEHPGKLLFAPNLLLDRNQGKCVEGMVEIFDMLLATSSRF

RMMNLQGEEFVCLKSIILLNSGVYTFLSSTLKSLEEKDHIHRALDKITDTLIHLMAKAGL

TLQQQHQRLAQLLLILSHIRHMSNKGMEHLYSMKYKNVVPLYDLLLEMLDAHRLHAG

GSGASRVQAFADALDDKFLHDMLAEGLRYSVIREVLPTRRARTFDLEVEELHTLVAEG

VVVHNC

37R3-3 INTEIN (SEQ ID NO: 24)

CLAEGTRIFDPVTGTTHRIEDVVDGRKPIHVVAVAKDGTLLARPVVSWFDQGTRDVIGL

RIAGGATVWATPDHKVLTEYGWRAAGELRKGDRVAGPGGSGNSLALSLTADQMVSA

LLDAEPPILYSEYDPTSPFSEASMMGLLTNLADRELVHMINWAKRVPGFVDLTLHDQA

HLLERAWLEILMIGLVWRSMEHPGKLLFAPNLLLDRNQGKCVEGMVEIFDMLLATSSR

FRMMNLQGEEFVCLKSIILLNSGVYTFLSSTLKSLEEKDHIHRALDKITDTLIHLMAKAG

LTLQQQHQRLAQLLLILSHIRHMSNKGMEHLYSMKYKNVVPLYDLLLEMLDAHRLHA

GGSGASRVQAFADALDDKFLHDMLAEELRYSVIREVLPTRRARTFDLEVEELHTLVAE

GVVVHNC

In various embodiments, the split inteins can be used to separately deliver separate portions of a complete Base editor fusion protein to a cell, which upon expression in a cell, become reconstituted as a complete Base editor fusion protein through the trans splicing.

In some embodiments, the disclosure provides a method of delivering a Base editor fusion protein to a cell, comprising: constructing a first expression vector encoding an N-terminal fragment of the Base editor fusion protein fused to a first split intein sequence; constructing a second expression vector encoding a C-terminal fragment of the Base editor fusion protein fused to a second split intein sequence; delivering the first and second expression vectors to a cell, wherein the N-terminal and C-terminal fragment are reconstituted as the Base editor fusion protein in the cell as a result of trans splicing activity causing self-excision of the first and second split intein sequences.

In other embodiments, the split site is in the napDNAbp domain.

In still other embodiments, the split site is in the adenosine deaminase domain.

In yet other embodiments, the split site is in the linker.

In other embodiments, the base editors may be delivered by ribonucleoprotein complexes.

In this aspect, the base editors may be delivered by non-viral delivery strategies involving delivery of a base editor complexed with a gRNA (i.e., a BE ribonucleoprotein complex) by various methods, including electroporation and lipid nanoparticles. Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995): Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

In some aspects, the invention provides methods comprising delivering one or more fusion proteins or polynucleotides encoding such fusion proteins, such as or one or more vectors as described herein encoding one or more components of the mtDNA editing system provided herein (e.g., deamination of mitochondrial DNA by a fusion protein or multiple fusion proteins) described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a base editor (e.g., deaminating enzyme) as described herein in combination with (and optionally complexed with) a guide domain (e.g., mitoTALE) is delivered to a cell. Conventional viral and non-viral based gene transfer methods can be used to introduce nucleic acids in mammalian cells or target tissues. Such methods can be used to administer nucleic acids encoding components of a base editor to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Feigner, TIBTECH 11:211-217 (1993): Mitani & Caskey, TIBTECH 11:162-166 (1993); Dillon, TIBTECH 11:167-175 (1993); Miller, Nature 357:455-460 (1992); Van Brunt. Biotechnology 6(10):1149-1154 (1988): Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bihm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386; 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner: WO 91/17424 and WO 91/16024. Delivery can be to cells (e.g., in vitro or ex vivo administration) or target tissues (e.g., in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995): Behr et al., Bioconjugate Chem. 5:382-389 (1994); Remy et al., Bioconjugate Chem. 5:647-654 (1994): Gao et al., Gene Therapy 2:710-722 (1995); Ahmad et al., Cancer Res. 52:4817-4820 (1992): U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated, and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al. Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka. PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US 2003-0087817, incorporated herein by reference.

gRNAs

Some aspects of the invention relate to guide sequences ("guide RNA" or "gRNA") that are capable of guiding a napDNAbp or a base editor comprising a napDNAbp to a target site in a DNA molecule. In various embodiments base editors (e.g., base editors provided herein) can be complexed, bound, or otherwise associated with (e.g., via any type of covalent or non-covalent bond) one or more guide sequences, i.e., the sequence which becomes associated or bound to the base editor and directs its localization to a specific target sequence having complementarity to the guide sequence or a portion thereof. The particular design aspects of a guide sequence will depend upon the nucleotide sequence of a genomic target site of interest and the type of napDNA/RNAbp (e.g., type of Cas protein) present in the base editor, among other factors, such as PAM sequence locations, percent G/C content in the target sequence, the degree of microhomology regions, secondary structures, etc.

In embodiments relating mtDNA base editors comprising Cas9/gRNA complexes, the Cas9 and gRNA components will need to be localized to the mitochondria. Cas9 can be modified with one or more MTS as discussed herein. In addition, the guide RNA may be localized to the mitochondria using known localization techniques for mRNA localization to mitochondria.

In general, a guide sequence is any polynucleotide sequence having sufficient complementarity with a target polynucleotide sequence to hybridize with the target sequence and direct sequence-specific binding of a napDNAbp (e.g., a Cas9, Cas9 homolog, or Cas9 variant) to the target sequence, such as a sequence within an SMN2 gene that comprises a C840T point mutation. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.). SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 31, 32, 33, 34, 35, 40, 45, 50, 75, or more nucleotides in length.

In some embodiments, a guide sequence is less than about 75, 50, 45, 40, 35, 30, 25, 20, 15, 12, or fewer nucleotides in length. The ability of a guide sequence to direct sequence-specific binding of a base editor to a target sequence may be assessed by any suitable assay. For example, the components of a base editor, including the guide sequence to be tested, may be provided to a host cell having the corresponding target sequence (e.g., a HGADFN 167 or HGADFN 188 cell line), such as by transfection with vectors encoding the components of a base editor disclosed herein, followed by an assessment of preferential cleavage within the target sequence, such as by Surveyor assay as described herein. Similarly, cleavage of a target polynucleotide sequence may be evaluated in a test tube by providing the target sequence, components of a base editor, including the guide sequence to be tested and a control guide sequence different from the test guide sequence, and comparing binding or rate of cleavage at the target sequence between the test and control guide sequence reactions. Other assays are possible, and will occur to those skilled in the art. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are well known in the art and can be used with the base editors described herein.

Additional exemplary guide sequences are disclosed in, for example, Jinek M., et al., Science 337:816-821(2012); Mali P. Esvelt K M & Church G M (2013) Cas9 as a versatile tool for engineering biology. Nature Methods, 10. 957-963: Li J F et al., (2013) Multiplex and homologous recombination-mediated genome editing in *Arabidopsis* and *Nicotiana benthamiana* using guide RNA and Cas9, Nature Biotechnology, 31, 688-691; Hwang, W. Y. et al., Efficient genome editing in zebrafish using a CRISPR-Cas system, Nature Biotechnology 31, 227-229 (2013); Cong L et al., (2013) Multiplex genome engineering using CRIPSR/Cas systems, Science, 339, 819-823; Cho S W et al., (2013) Targeted genome engineering in human cells with the Cas9 RNA-guided endonuclease, Nature Biotechnology, 31, 230-232; Jinek, M. et al., RNA-programmed genome editing in human cells, eLife 2, e00471 (2013); Dicarlo, J. E. et al., Genome engineering in *Saccharomyces cerevisiae* using CRISPR-Cas systems. Nucleic Acid Res. (2013); Briner A E et al., (2014) Guide RNA functional modules direct Cas9 activity and orthogonality. Mol Cell, 56. 333-339, the entire contents of each of which are herein incorporated by reference.

Methods of Treatment

The instant disclosure provides methods for the treatment of a subject diagnosed with a disease associated with or caused by a point mutation that can be corrected by the mtDNA editing system provided herein (e.g., deamination of mitochondrial DNA by a fusion protein or multiple fusion proteins). For example, in some embodiments, a method is provided that comprises administering to a subject having such a disease (e.g., MELAS/Leigh syndrome and Leber's hereditary optic neuropathy, other disorders associated with a point mutation as described above), an effective amount of the mtDNA editing system provided herein (e.g., deamination of mitochondrial DNA by a fusion protein or multiple fusion proteins) described herein that corrects the point mutation or introduces a point mutation comprising desired genetic change. In some embodiments, a method is provided that comprises administering to a subject having such a disease, (e.g., MELAS/Leigh syndrome and Leber's hereditary optic neuropathy, other disorders associated with a point mutation as described above), an effective amount of the mtDNA editing system provided herein (e.g., deamination of mitochondrial DNA by a fusion protein or multiple fusion proteins) described herein that corrects the point mutation or introduces a deactivating mutation into a disease-associated gene. In some embodiments, the disease is a proliferative disease. In some embodiments, the disease is a genetic disease. In some embodiments, the disease is a mitochondrial disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders (e.g., diseases or disorders that are associated with or caused by a point mutation that can be corrected by the mtDNA editing system provided herein (e.g., deamination of mitochondrial DNA by a fusion protein or multiple fusion proteins) provided herein). Some such diseases are described herein, and additional suitable diseases that can be treated with the strategies and fusion proteins, or nucleic acids thereof, provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different (e.g., in precursors of a mature protein and the mature protein itself), and differences in sequences from species to species may affect numbering. One of skill in the art will be able to identify the respective residue in any homologous protein and in the respective encoding nucleic acid by methods well known in the art (e.g., by sequence alignment and determination of homologous residues). Exemplary suitable diseases and disorders include, without limitation: MELAS/Leigh syndrome and Leber's hereditary optic neuropathy.

The mtDNA base editors described herein may be used to treat any mitochrondrial disease or disorder. As used herein, "mitochondrial disorders" related to disorders which are due to abnormal mitochondria such as for example, a mitochondrial genetic mutation, enzyme pathways etc. Examples of disorders include and are not limited to: loss of motor control, muscle weakness and pain, gastro-intestinal disorders and swallowing difficulties, poor growth, cardiac disease, liver disease, diabetes, respiratory complications, seizures, visual/hearing problems, lactic acidosis, developmental delays and susceptibility to infection.

The mitochondrial abnormalities give rise to "mitochondrial diseases" which include, but not limited to: AD: Alzheimer's Disease; ADPD: Alzheimer's Disease and Parkinsons's Disease; AMDF: Ataxia, Myoclonus and Deafness CIPO: Chronic Intestinal Pseudoobstruction with myopathy and Opthalmoplegia; CPEO: Chronic Progressive External Opthalmoplegia: DEAF: Maternally inherited DEAFness or aminoglycoside-induced DEAFness; DEMCHO: Dementia and Chorea; DMDF: Diabetes Mellitus & DeaFness; Exercise Intolerance; ESOC: Epilepsy. Strokes, Optic atrophy, & Cognitive decline; FBSN: Familial Bilateral Striatal Necrosis; FICP: Fatal Infantile Cardiomyopathy Plus, a MELAS-associated cardiomyopathy: GER: Gastrointestinal Reflux; KSS Kearns Sayre Syndrome LDYT: Leber's hereditary optic neuropathy and DYsTonia; LHON: Leber Hereditary Optic Neuropathy: LFMM: Lethal Infantile Mitochondrial Myopathy; MDM: Myopathy and Diabetes Mellitus; MELAS:

Mitochondrial Encephalomyopathy, Lactic Acidosis, and Stroke-like episodes: MEPR: Myoclonic Epilepsy and Psychomotor Regression; MERME: MERRFIMELAS overlap disease: MERRF: Myoclonic Epilepsy and Ragged Red Muscle Fibers; MHCM: Maternally Inherited Hypertrophic CardioMyopathy; MICM: Maternally Inherited Cardiomyopathy; MILS: Maternally Inherited Leigh Syndrome; Mitochondrial Encephalocardiomyopathy; Mitochondrial Encephalomyopathy; MM: Mitochondrial Myopathy; MMC: Maternal Myopathy and Cardiomyopathy; Multisystem Mitochondrial Disorder (myopathy, encephalopathy, blindness, hearing loss, peripheral neuropathy); NARP: Neurogenic muscle weakness, Ataxia, and Retinitis Pigmentosa; alternate phenotype at this locus is reported as Leigh Disease; NIDDM: Non-Insulin Dependent Diabetes Mellitus: PEM: Progressive Encephalopathy; PME: Progressive Myoclonus Epilepsy; RTT: Rett Syndrome; SIDS: Sudden Infant Death Syndrome.

In embodiments, a mitochondrial disorder that may be treatable using the mtDNA base editors described herein include Myoclonic Epilepsy with Ragged Red Fibers (MERRF): Mitochondrial Myopathy, Encephalopathy, Lactacidosis, and Stroke (MELAS): Maternally Inherited Diabetes and Deafness (MIDD); Leber's Hereditary Optic Neuropathy (LHON); chronic progressive external ophthalmoplegia (CPEO); Leigh Disease: Keams-Sayre Syndrome (KSS); Friedreich's Ataxia (FRDA); Co-Enzyme QIO (CoQIO) Deficiency; Complex 1 Deficiency; Complex II Deficiency; Complex III Deficiency; Complex IV Deficiency: Complex V Deficiency; other myopathies: cardiomyopathy: encephalomyopathy; renal tubular acidosis; neurodegenerative diseases: Parkinson's disease; Alzheimer's disease; amyotrophic lateral sclerosis (ALS); motor neuron diseases; hearing and balance impairments; or other neurological disorders; epilepsy; genetic diseases; Huntington's Disease; mood disorders; nucleoside reverse transcriptase inhibitors (NRTI) treatment: HIV-associated neuropathy; schizophrenia; bipolar disorder; age-associated diseases: cerebral vascular diseases; macular degeneration; diabetes; and cancer.

Pharmaceutical Compositions

Other aspects of the present disclosure relate to pharmaceutical compositions comprising any of the various components of the mtDNA editing system provided herein (e.g., deamination of mitochondrial DNA by a fusion protein or multiple fusion proteins) described herein (e.g., including, but not limited to, the mitoTALE, DddA, or portions thereof, and fusion proteins (e.g., comprising mitoTALE and portion of DddA)).

The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt: (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin. HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject (e.g., for nucleic acid editing). Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition is formulated in accordance with routine procedures as a composition adapted for intravenous or subcutaneous administration to a subject (e.g., a human). In some embodiments, pharmaceutical composition for administration by injection are solutions in sterile isotonic aqueous buffer. Where necessary, the pharmaceutical can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid (e.g., sterile saline, lactated Ringer's or Hank's solution). In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P, et al., Gene Ther. 1999, 6:1438-47). Positively charged lipids such as N-[1-(2,3-dioleoyloxi)propyl]-N,N,N-trimethyl-amoniummethylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent: i.e., carrier, or vehicle.

Further, the pharmaceutical composition can be provided as a pharmaceutical kit comprising: (a) a container containing a compound of the invention in lyophilized form; and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use, or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Delivery Methods

In another aspect, the present disclosure provides for the delivery of mtDNA base editors in vitro and in vivo using various strategies, including on separate vectors using split inteins and as well as direct delivery strategies of the ribonucleoprotein complex (i.e., the base editor complexed to the gRNA and/or the second-site gRNA) using techniques such as electroporation, use of cationic lipid-mediated formulations, and induced endocytosis methods using receptor ligands fused to the ribonucleoprotein complexes. In addition, mRNA delivery methods may also be employed. Any such methods are contemplated herein. The mtDNA BE fusion proteins, or components thereof, preferably be modified with an MTS or other signal sequence that facilitates entry of the polypeptides and the guide RNAs (in the case where a pDNAbp is Cas9) into the mitochondria.

In some aspects, the invention provides methods comprising delivering one or more base editor-encoding and/or gRNA-encoding polynucleotides, such as or one or more vectors as described herein encoding one or more components described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a base editor as described herein in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a base editor to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Feigner, TIBTECH 11:211-217 (1993); Mitani & Caskey, TIBTECH 11:162-166 (1993): Dillon, TIBTECH 11:167-175 (1993); Miller, Nature 357:455-460 (1992); Van Brunt, Biotechnology 6(10):1149-1154 (1988); Vigne. Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bihm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424: WO 91/16024. Delivery can be to cells (e.g. in vitro or ex vivo administration) or target tissues (e.g. in vivo administration). The preparation of lipid:nucleic acid complexes, including targeted liposomes such as immunolipid complexes, is well known to one of skill in the art (see, e.g., Crystal. Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In various embodiments, the base editor constructs (including, the split-constructs) may be engineered for delivery in one or more rAAV vectors. An rAAV as related to any of the methods and compositions provided herein may be of any serotype including any derivative or pseudotype (e.g., 1, 2, 3, 4, 5, 6, 7, 8, 9, 10, 11, 12, 13, 2/1, 2/5, 2/8, 2/9, 3/1, 3/5, 3/8, or 3/9). An rAAV may comprise a genetic load (i.e., a recombinant nucleic acid vector that expresses a gene of interest, such as a whole or split base editor fusion protein that is carried by the rAAV into a cell) that is to be delivered to a cell. An rAAV may be chimeric.

As used herein, the serotype of an rAAV refers to the serotype of the capsid proteins of the recombinant virus. Non-limiting examples of derivatives and pseudotypes include rAAV2/1, rAAV2/5, rAAV2/8, rAAV2/9, AAV2-AAV3 hybrid, AAVrh.10, AAVhu.14, AAV3a/3b, AAVrh32.33, AAV-HSC15, AAV-HSC17. AAVhu.37, AAVrh.8, CHt-P6, AAV2.5, AAV6.2, AAV2i8, AAV-HSC15/17, AAVM41, AAV9.45, AAV6(Y445F/Y731F), AAV2.5T. AAV-HAE1/2, AAV clone 32/83, AAVShH10, AAV2 (Y→F), AAV8 (Y733F), AAV2.15, AAV2.4, AAVM41, and AAVr3.45. A non-limiting example of derivatives and pseudotypes that have chimeric VP1 proteins is rAAV2/5-1VP1u, which has the genome of AAV2, capsid backbone of AAV5 and VP1u of AAV1. Other non-limiting example of derivatives and pseudotypes that have chimeric VP1 proteins are rAAV2/5-8VP1u, rAAV2/9-1VP1u, and rAAV2/9-8VP1u.

AAV derivatives/pseudotypes, and methods of producing such derivatives/pseudotypes are known in the art (see, e.g., *Mol Ther.* 2012 April; 20(4):699-708. doi: 10.1038/mt.2011.287. Epub 2012 Jan. 24. The AAV vector toolkit: poised at the clinical crossroads. Asokan A1. Schaffer D V, Samulski R J.). Methods for producing and using pseudotyped rAAV vectors are known in the art (see, e.g., Duan et al., *J. Virol.,* 75:7662-7671, 2001; Halbert et al., *J. Virol.,* 74:1524-1532. 2000: Zolotukhin et al., Methods, 28:158-167, 2002; and Auricchio et al. *Hum. Molec. Genet.,* 10:3075-3081, 2001).

Methods of making or packaging rAAV particles are known in the art and reagents are commercially available (see, e.g., Zolotukhin et al. Production and purification of serotype 1. 2, and 5 recombinant adeno-associated viral vectors. *Methods* 28 (2002) 158-167; and U.S. Patent Publication Numbers US20070015238 and US20120322861, which are incorporated herein by reference; and plasmids and kits available from ATCC and Cell Biolabs, Inc.). For example, a plasmid comprising a gene of interest may be combined with one or more helper plasmids, e.g., that contain a rep gene (e.g., encoding Rep78, Rep68. Rep52 and Rep40) and a cap gene (encoding VP1, VP2, and VP3, including a modified VP2 region as described herein), and transfected into a recombinant cells such that the rAAV particle can be packaged and subsequently purified.

Recombinant AAV may comprise a nucleic acid vector, which may comprise at a minimum: (a) one or more heterologous nucleic acid regions comprising a sequence encoding a protein or polypeptide of interest or an RNA of interest (e.g., a siRNA or microRNA), and (b) one or more regions comprising inverted terminal repeat (ITR) sequences (e.g., wild-type ITR sequences or engineered ITR sequences) flanking the one or more nucleic acid regions (e.g., heterologous nucleic acid regions). Herein, heterologous nucleic acid regions comprising a sequence encoding a protein of interest or RNA of interest are referred to as genes of interest.

Any one of the rAAV particles provided herein may have capsid proteins that have amino acids of different serotypes outside of the VP1u region. In some embodiments, the serotype of the backbone of the VP1 protein is different from the serotype of the ITRs and/or the Rep gene. In some embodiments, the serotype of the backbone of the VP1 capsid protein of a particle is the same as the serotype of the ITRs. In some embodiments, the serotype of the backbone of the VP1 capsid protein of a particle is the same as the serotype of the Rep gene. In some embodiments, capsid proteins of rAAV particles comprise amino acid mutations that result in improved transduction efficiency.

In some embodiments, the nucleic acid vector comprises one or more regions comprising a sequence that facilitates expression of the nucleic acid (e.g., the heterologous nucleic acid), e.g., expression control sequences operatively linked to the nucleic acid. Numerous such sequences are known in the art. Non-limiting examples of expression control sequences include promoters, insulators, silencers, response elements, introns, enhancers, initiation sites, termination signals, and poly(A) tails. Any combination of such control sequences is contemplated herein (e.g., a promoter and an enhancer).

Final AAV constructs may incorporate a sequence encoding the gRNA. In other embodiments, the AAV constructs may incorporate a sequence encoding the second-site nicking guide RNA. In still other embodiments, the AAV constructs may incorporate a sequence encoding the second-site nicking guide RNA and a sequence encoding the gRNA.

In various embodiments, the gRNAs can be expressed from an appropriate promoter, such as a human U6 (hU6) promoter, a mouse U6 (mU6) promoter, or other appropriate promoter. The gRNAs (if multiple) can be driven by the same promoters or different promoters.

In some embodiments, a rAAV constructs or the herein compositions are administered to a subject enterally. In some embodiments, a rAAV constructs or the herein compositions are administered to the subject parenterally. In some embodiments, a rAAV particle or the herein compositions are administered to a subject subcutaneously, intraocularly, intravitreally, subretinally, intravenously (IV), intracerebroventricularly, intramuscularly, intrathecally (IT), intracisternally, intraperitoneally, via inhalation, topically, or by direct injection to one or more cells, tissues, or organs. In some embodiments, a rAAV particle or the herein compositions are administered to the subject by injection into the hepatic artery or portal vein.

In other aspects, the base editors can be divided at a split site and provided as two halves of a whole/complete base editor. The two halves can be delivered to cells (e.g., as expressed proteins or on separate expression vectors) and once in contact inside the cell, the two halves form the complete base editor through the self-splicing action of the inteins on each base editor half. Split intein sequences can be engineered into each of the halves of the encoded base editor to facilitate their transplicing inside the cell and the concomitant restoration of the complete, functioning base editor.

These split intein-based methods overcome several barriers to in vivo delivery. For example, the DNA encoding base editors is larger than the rAAV packaging limit, and so requires special solutions. One such solution is formulating the editor fused to split intein pairs that are packaged into two separate rAAV particles that, when co-delivered to a cell, reconstitute the functional editor protein.

In this aspect, the base editors can be divided at a split site and provided as two halves of a whole/complete base editor. The two halves can be delivered to cells (e.g., as expressed proteins or on separate expression vectors) and once in contact inside the cell, the two halves form the complete base editor through the self-splicing action of the inteins on each base editor half. Split intein sequences can be engineered into each of the halves of the encoded base editor to facilitate their transplicing inside the cell and the concomitant restoration of the complete, functioning base editor.

In various embodiments, the base editors may be engineered as two half proteins (i.e., a ABE N-terminal half and a CBE C-terminal half) by "splitting" the whole base editor as a "split site." The "split site" refers to the location of insertion of split intein sequences (i.e., the N intein and the C intein) between two adjacent amino acid residues in the base editor. More specifically, the "split site" refers to the location of dividing the whole base editor into two separate halves, wherein in each halve is fused at the split site to either the N intein or the C intein motifs. The split site can be at any suitable location in the base editor fusion protein, but preferably the split site is located at a position that allows for the formation of two half proteins which are appropriately sized for delivery (e.g., by expression vector) and wherein the inteins, which are fused to each half protein at the split site termini, are available to sufficiently interact with one another when one half protein contacts the other half protein inside the cell.

In some embodiments, the split site is located in the pDNAbp domain. In other embodiments, the split site is located in the double stranded deaminase domain (DddA). In other embodiments, the split site is located in a linker that joins the napDNAbp domain and the deaminase domain. Preferably, the DddA is split so as to inactive the deaminase activity until the split fragments are co-localized in the mitochondria at the target site.

In various embodiments, split site design requires finding sites to split and insert an N- and C-terminal intein that are both structurally permissive for purposes of packaging the two half base editor domains into two different AAV genomes. Additionally, intein residues necessary for trans splicing can be incorporated by mutating residues at the N terminus of the C terminal extein or inserting residues that will leave an intein "scar."

In various embodiments, using SpCas9 nickase as an example, the split can be between any two amino acids between 1 and 1368 of SEQ ID NO: 28. Preferred splits, however, will be located between the central region of the protein, e.g., from amino acids 50-1250, or from 100-1200, or from 150-1150, or from 200-1100, or from 250-1050, or from 300-1000, or from 350-950, or from 400-900, or from 450-850, or from 500-800, or from 550-750, or from 600-700 of SEQ ID NO: 28. In specific exemplary embodiments, the split site may be between 740/741, or 801/802, or 1010/1011, or 1041/1042. In other embodiments the split site may be between 1/2, 2/3, 3/4.4/5, 5/6, 6/7, 7/8, 8/9, 9/10, 10/11, 12/13, 14/15, 15/16, 17/18, 19/20 . . . 50/51 . . . 100/101 . . . 200/201 . . . 300/301 . . . 400/401 . . . 500/501 . . . 600/601 . . .

700/701 . . . 800/801 . . . 900/901 . . . 1000/1001 . . . 1100/1101 . . . 1200/1201 . . . 1300/1301 . . . and 1367/1368, including all adjacent pairs of amino acid residues.

In various embodiments, the split inteins can be used to separately deliver separate portions of a complete Base editor fusion protein to a cell, which upon expression in a cell, become reconstituted as a complete Base editor fusion protein through the trans splicing.

In some embodiments, the disclosure provides a method of delivering a Base editor fusion protein to a cell, comprising: constructing a first expression vector encoding an N-terminal fragment of the Base editor fusion protein fused to a first split intein sequence; constructing a second expression vector encoding a C-terminal fragment of the Base editor fusion protein fused to a second split intein sequence: delivering the first and second expression vectors to a cell, wherein the N-terminal and C-terminal fragment are reconstituted as the Base editor fusion protein in the cell as a result of trans splicing activity causing self-excision of the first and second split intein sequences.

In other embodiments, the split site is in the napDNAbp domain.

In still other embodiments, the split site is in the deaminase domain.

In yet other embodiments, the split site is in the linker.

In other embodiments, the base editors may be delivered by ribonucleoprotein complexes.

In this aspect, the base editors may be delivered by non-viral delivery strategies involving delivery of a base editor complexed with a gRNA (i.e., a ABE ribonucleoprotein complex) by various methods, including electroporation and lipid nanoparticles. Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995): Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995): Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

Kits, Vectors, Cells

Some aspects of this disclosure provide kits comprising a fusion protein or a nucleic acid construct comprising a nucleotide sequence encoding the various components (e.g., fusion protein) of the mtDNA editing system provided herein (e.g., deamination of mitochondrial DNA by a fusion protein or multiple fusion proteins) described herein (e.g., including, but not limited to, the mitoTALE-DddA fusion proteins, vectors or cells comprising the same). In some embodiments, the nucleotide sequence comprises a heterologous promoter that drives expression of the fusion protein editing system components described herein.

Some aspects of this disclosure provide kits comprising one or more fusion proteins or nucleic acid constructs encoding the various components of the mtDNA editing system provided herein (e.g., deamination of mitochondrial DNA by a fusion protein or multiple fusion proteins) described herein, e.g., the comprising a nucleotide sequence encoding the components of the mtDNA editing system provided herein (e.g., deamination of mitochondrial DNA by a fusion protein or multiple fusion proteins) capable of modifying a target DNA sequence. In some embodiments, the nucleotide sequence comprises a heterologous promoter that drives expression of the mtDNA editing system provided herein (e.g., deamination of mitochondrial DNA by a fusion protein or multiple fusion proteins) components.

In some embodiments, a kit further comprises a set of instructions for using the fusion proteins and/or carrying out the methods herein.

Some aspects of this disclosure provides kits comprising a nucleic acid construct, comprising (a) a nucleotide sequence encoding a fusion protein (e.g., a mitoTALE and portion of a DddA) and (b) a heterologous promoter that drives expression of the sequence of (a).

Some aspects of this disclosure provide cells comprising any of the constructs disclosed herein. In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM. MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast. 3T3 Swiss, 3T3-L1, 132-d5 human fetal fibroblasts; 10.1 mouse fibroblasts, 293-T, 3T3, 721, 9L, A2780, A2780ADR, A2780cis. A 172, A20, A253, A431, A-549, ALC, B16, B35, BCP-1 cells, BEAS-2B, bEnd.3, BHK-21, BR 293. BxPC3. C3H-OTI/2, C6/36, Cal-27, CHO, CHO-7, CHO-IR, CHO-KL, CHO-K2, CHO-T, CHO Dhfr -/-, COR-L23, COR-L23/CPR, COR-L23/5010, COR-L23/R23, COS-7, COV-434, CML T1, CMT, CT26. D17, DH82, DU145, DuCaP, EL4, EM2, EM3, EMT6/AR1, EMT6/AR10.0, FM3. H1299. H69. HB54. HB55, HCA2, HEK-293. HeLa. Hepalclc7, HL-60. HMEC, HT-29, Jurkat, JY cells, K562 cells, Ku812, KCL22. KG1, KYOl. LNCap, Ma-Mel 1-48, MC-38, MCF-7, MCF-10A, MDA-MB-231, MDA-MB-468, MDA-MB-435, MDCK I, MDCK 11, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer. PNT-1A/PNT 2, RenCa, RIN-5F, RMA/RMAS, Saos-2 cells, Sf-9, SkBr3, T2, T-47D, T84, THPl cell line, U373, U87, U937, VCaP. Vero cells, WM39, WT-49, X63, YAC-1. YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a fusion protein system as described herein (such as by transient transfection of one or more vectors, or transfection with RNA), and modified through the activity of a fusion protein complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

Other Embodiments

In yet further aspects, the present application provides the following embodiments as reflected in the following numbered paragraphs:

1. A non-naturally occurring polypeptide variant comprising a double-stranded DNA deaminase activity.

2. The non-naturally occurring polypeptide variant of paragraph 1, wherein the polypeptide comprises a minimum domain conferring double-stranded DNA deaminase activity.

3. The non-naturally occurring polypeptide variant of paragraph 2, wherein the minimum domain corresponds to amino acid residues 1261-1427 of (i) full-length DddA of SEQ ID NO: 1 of *Burkholderia cenocepacias*, (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

4. The non-naturally occurring polypeptide variant of paragraph 2, wherein the minimum domain corresponds to amino acid residues 1290-1425 of (i) full-length DddA of SEQ ID NO: 1 of *Burkholderia* cenocepacias, (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

5. The non-naturally occurring polypeptide variant of paragraph 1, wherein the minimum domain corresponds to SEQ ID NO: 19, or to an amino acid sequence having at least 90% sequence identity to SEQ ID NO: 19, wherein SEQ ID NO: 19 corresponds to amino acids 1251-1427 of SEQ ID NO: 1.

6. The non-naturally occurring polypeptide variant of paragraph 1, wherein the minimum domain corresponds to SEQ ID NO: 20, or to an amino acid sequence having at least 90% sequence identity to SEQ ID NO: 20, wherein SEQ ID NO: 20 corresponds to amino acids 1290-1425 of SEQ ID NO: 1.

7. A non-naturally occurring polypeptide fragment of a double-stranded DNA deaminase.

8. The non-naturally occurring polypeptide fragment of paragraph 7, wherein the polypeptide fragment comprises a minimum domain conferring double-stranded DNA deaminase activity.

9. The non-naturally occurring polypeptide fragment of paragraph 8, wherein the minimum domain corresponds to amino acid residues 1261-1427 of (i) full-length DddA of SEQ ID NO: 1 of *Burkholderia* cenocepacias. (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

10. The non-naturally occurring polypeptide fragment of paragraph 8, wherein the minimum domain corresponds to amino acid residues 1290-1425 of (i) full-length DddA of SEQ ID NO: 1 of *Burkholderia* cenocepacias. (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

11. The non-naturally occurring polypeptide fragment of paragraph 8 having the amino acid sequence of SEQ ID NO: 19, or an amino acid sequence having at least 90% sequence identity to SEQ ID NO: 19.

12. The non-naturally occurring polypeptide fragment of paragraph 8 having the amino acid sequence of SEQ ID NO: 20, or an amino acid sequence having at least 90% sequence identity to SEQ ID NO: 20.

13. A non-naturally occurring polypeptide fragment of a double-stranded DNA deaminase obtained by splitting the deaminase in the deaminase domain at a split site.

14. The non-naturally occurring polypeptide fragment of paragraph 13, wherein the fragment corresponds to an N-terminal half fragment, wherein said fragment comprises an N-terminal portion of a split deaminase domain.

15. The non-naturally occurring polypeptide fragment of paragraph 13, wherein the fragment corresponds to a C-terminal half fragment, wherein said fragment comprises a C-terminal portion of a split deaminase domain.

16. The non-naturally occurring polypeptide fragment of paragraph 14, wherein the deaminase activity is restored upon co-localizing the N-terminal half fragment with a C-terminal half fragment.

17. The non-naturally occurring polypeptide fragment of paragraph 15, wherein the deaminase activity is restored upon co-localizing the C-terminal half fragment with an N-terminal half fragment.

18. The non-naturally occurring polypeptide fragment of any one of paragraphs 13-17, wherein the amino acid sequence of the double-stranded DNA deaminase that is split is any one of SEQ ID NO: 1. 3, 5, 7, 9, 11, 13, 15, or 17, or an amino acid sequence having at least 90% sequence identity to any one of SEQ ID NO: 1, 3, 5, 7, 9, 11, 13, 15, or 17.

19. The non-naturally occurring polypeptide fragment of any one of paragraphs 13-18, wherein the split site is at the peptide bond immediately following residue G1322, G1333, A1343, N1357, G1371. N1387, or G1397 of the amino acid sequence of SEQ ID NO: 1, or at a corresponding split site in an amino acid sequence having at least 90% sequence identity to SEQ ID NO: 1.

20. The non-naturally occurring polypeptide fragment of paragraphs 14, wherein the N-terminal half fragment comprises an amino acid sequence of SEQ ID NOs: 349 or 351, or an amino acid sequence having at least 90% sequence identity to any of SEQ ID NOs: 349 or 351.

21. The non-naturally occurring polypeptide fragment of paragraphs 15, wherein the C-terminal half fragment comprises an amino acid sequence of SEQ ID NOs: 350 or 352, or an amino acid sequence having at least 90% sequence identity to any of SEQ ID NOs: 350 or 352.

22. A base editor comprising a heterodimer having first and second monomers, said first monomer comprising a first programmable DNA binding protein and an N-terminal or C-terminal fragment of a split double-stranded DNA deaminase, and said second monomer comprising a second programmable DNA binding protein and an N-terminal or C-terminal fragment of a split double-stranded DNA deaminase, wherein dimerization of the first and second monomers reconstitutes the double-stranded DNA deaminase activity.

23. The base editor of paragraph 22, wherein the first and/or second programmable DNA binding protein are the same.

24. The base editor of paragraph 22, wherein the first and/or second programmable DNA binding protein are different.

25. The base editor of paragraph 22, wherein the first and/or second programmable DNA binding protein is a nucleic acid programmable DNA binding protein (napDNAbp).

26. The base editor of paragraph 25, wherein the napDNAbp is a Cas9 domain.

27. The base editor of paragraph 25, wherein the napDNAbp is a nickase.

28. The base editor of paragraph 25, wherein the napDNAbp comprises an inactivated nuclease activity.

29. The base editor of paragraph 25, wherein the napDNAbp is selected from the group consisting of: Cas9, Cas12e. Cas12d, Cas12a, Cas12b1, Cas13a, Cas12c, and Argonaute and optionally has a nickase activity.

30. The base editor of paragraph 25, wherein the napDNAbp comprises an amino acid sequence selected from the group consisting of SEQ ID NO: 28, 31, 33, 35, 36-91. 353, and 354, or an amino acid sequence having at least 90% sequence identity to an amino acid sequence selected from the group consisting of: SEQ ID NOs: 8, 31, 33, 35, 36-91, 353, and 354.

31. The base editor of paragraph 22, wherein the programmable DNA binding protein is a TALE protein.

32. The base editor of paragraph 31, wherein TALE protein comprises an amino acid sequence selected from the group consising of SEQ ID NOs: 1-12, or an amino acid sequence having at least 90% sequence identity with an amino acid sequence selected from the group consising of SEQ ID NOs: 1-12.

33. The base editor of paragraph 22, wherein the programmable DNA binding protein is a zinc finger protein.

34. The base editor of paragraph 33, wherein zinc finger protein is a commercially available zinc finger protein.

35. The base editor of paragraph 22, wherein the programmable DNA binding protein is a mitoTALE protein.

36. The base editor of paragraph 35, wherein mitoTALE protein comprises an amino acid sequence selected from the group consisting of: SEQ ID NO: 1-12, or an amino acid sequence having at least 90% sequence identity with an amino acid sequence selected from the group consisting of SEQ ID NO: 1-12.

37. The base editor of paragraph 22, wherein the N-terminal fragment of the split double-stranded DNA deaminase double-stranded DNA deaminase domain comprises an amino acid sequence of SEQ ID NO: 349 or 351, or an amino acid sequence having at least 90% sequence identity to any of SEQ ID NO: 349 or 351.

38. The base editor of paragraph 22, wherein the C-terminal fragment of the split double-stranded DNA deaminase double-stranded DNA deaminase domain comprises an amino acid sequence of SEQ ID NO: 350 or 352, or an amino acid sequence having at least 90% sequence identity to any of SEQ ID NO: 350 or 352.

39. The base editor of paragraph 22, wherein the C-terminal fragment and the N-terminal fragment of the split double-stranded DNA deaminase are obtained by splitting a double-stranded DNA deaminase in the deaminase domain at a split site.

40. The base editor of paragraph 39, wherein the double-stranded DNA deaminase comprises an amino acid sequence of SEQ ID NO: 1, 3, 5, 7, 9, 11, 13, 15, or 17, or an amino acid sequence having at least 90% sequence identity to any one of SEQ ID NO: 1, 3, 5, 7, 9, 11, 13, 15, or 17.

41. The base editor of paragraph 39, wherein the double-stranded DNA deaminase comprises a minimum domain conferring double-stranded DNA deaminase activity.

42. The base editor of paragraph 41, wherein the minimum domain corresponds to amino acid residues 1261-1427 of (i) full-length DddA of SEQ ID NO: 1 of *Burkholderia cenocepacias*. (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

43. The base editor of paragraph 41, wherein the minimum domain corresponds to amino acid residues 1290-1425 of (i) full-length DddA of SEQ ID NO: 1 of *Burkholderia cenocepacias*, (ii) a corresponding region of any one of the DddA homologs of SEQ ID NO: 3, 5, 7, 9, 11, 13, 15, or 17, or (iii) a corresponding region of an amino acid sequence having at least 90% sequence identity to SEQ ID NO: 1.

44. The base editor of paragraph 41, wherein the minimum domain comprises SEQ ID NO: 19, or an amino acid sequence having at least 90% sequence identity to SEQ ID NO: 19.

45. The base editor of paragraph 41, wherein the minimum domain comprises SEQ ID NO: 20, or an amino acid sequence having at least 90% sequence identity to SEQ ID NO: 19.

46. The base editor of paragraph 39, wherein the split site is at the peptide bond immediately following residue G1322, G1333, A1343, N1357, G1371. N1387, or G1397 of the amino acid sequence of SEQ ID NO: 1, or at a corresponding split site in an amino acid sequence having at least 90% sequence identity to SEQ ID NO: 1.

47. The base editor of paragraph 22, wherein the first monomer comprises a linker that joins the first programmable DNA binding protein with the N-terminal or C-terminal fragment of the split double-stranded DNA deaminase.

48. The base editor of paragraph 22, wherein the second monomer comprises a linker that joins the first programmable DNA binding protein with the N-terminal or C-terminal fragment of the split double-stranded DNA deaminase.

49. The base editor of paragraph 47 or 48, wherein the linker comprises an amino acid sequence selected from the group consisting of: SEQ ID NOs: 101-117, 357, 358, and 359, or an amino acid sequence having at least 90% sequence identity to SEQ ID NOs: 101-1 17, 357, 358, or 359.

50. The base editor of paragraph 47 or 48, wherein the linker comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids.

51. The base editor of paragraphs 47 or 48, wherein the linker comprises 2 amino acids.

52. The base editor of any one of paragraphs 22-51, further comprising one or more uracil glycosylase inhibitor (UGI) domains.

53. The base editor of paragraph 52, wherein the one or more UGI domains comprise an amino acid sequence selected from the group consisting of: SEQ ID NOs: 118 and 355, or an amino acid sequence having at least 90% sequence identity to SEQ ID NOs: 118 or 355.

54. The base editor of any one of paragraphs 22-53, further comprising one or more targeting sequences.

55. The base editor of paragraph 54, wherein the one or more targeting sequences is a nuclear localization sequence (NLS).

56. The base editor of paragraph 55, wherein the NLS comprises an amino acid sequence selected from the group consisting of: SEQ ID NOs: 119-129 and 356, or an amino acid sequence having at least 90% sequence identity to SEQ ID NOs: 119-129 or 356.

57. The base editor of paragraph 54, wherein the one or more targeting sequences is a mitochondrial targeting sequence (MTS).

58. The base editor of paragraph 57, wherein the MTS comprises an amino acid sequence selected from the group consisting of: SEQ ID NOs: 13, 14, and 299, or an amino acid sequence having at least 90% sequence identity to SEQ ID NOs: 13, 14, or 299.

59. The base editor of paragraph 57, wherein the MTS is an SOD2 having an amino acid sequence comprising SEQ ID NO: 13, or an amino acid sequence having at least 90% sequence identity to SEQ ID NO: 13.

60. The base editor of paragraph 57, wherein the MTS is a COX8a having an amino acid sequence comprising SEQ ID NO: 14, or an amino acid sequence having at least 90% sequence identity to SEQ ID NO: 14.

61. The base editor of paragraph 22, wherein the first and/or second monomers have one of the following structures:

(a) [A]-[programmable DNA binding protein]-[N-terminal or C-terminal fragment of a split double-stranded DNA deaminase]-[B]; or (b) [A]-[N-terminal or C-terminal fragment of a split double-stranded DNA deaminase]-[programmable DNA binding protein]-[B], wherein "[A]" and/or "[B]" represent optional one or more additional functional domains and wherein "]-[" is an optional linker.

62. The base editor of paragraph 61, wherein the optional one or more additional functional domains are selected from the group consisting of a uracil glycosylase inhibitor (UGI) domain and a targeting domain.

63. The base editor of paragraph 62, wherein the UGI domain comprises an amino acid sequence comprising SEQ ID NO: 335, or an amino acid sequence having at least 90% sequence identity to SEQ ID NO: 335.

64. The base editor of paragraph 62, wherein the targeting domain comprises an NLS having an amino acid sequence selected from the group consisting of: SEQ ID NOs: 119-129 and 356, or an amino acid sequence having at least 90% sequence identity to SEQ ID NOs: 119-129 or 356.

65. The base editor of paragraph 62, wherein the targeting domain comprises an MTS having an amino acid sequence comprising SEQ ID NO: 299, or an amino acid sequence having at least 90% sequence identity to SEQ ID NO: 299.

66. The base editor of paragraph 22, wherein the first monomer comprises the following structure: [SOD2]-$[UGI]_{1-2}$-[mitoTALE]-[$DddA_{tox}$-N of SEQ ID NO: 349 or $DddA_{tox}$-C of SEQ ID NO: 350]-$[UGI]_{1-2}$.

67. The base editor of paragraph 66, wherein the first monomer comprises an amino acid sequence comprising SEQ ID NO: 360, or an amino acid sequence having at least 90% sequence identity to SEQ ID NO: 360.

68. The base editor of paragraph 22, wherein the first monomer comprises the following structure: [COX8A]-$[UGI]_{1-2}$-[mitoTALE]-[$DddA_{tox}$-N of SEQ ID NO: 351 or $DddA_{tox}$-C of SEQ ID NO: 352]-$[UGI]_{1-2}$.

69. The base editor of paragraph 68, wherein the first monomer comprises an amino acid sequence of SEQ ID NO: 360, or an amino acid sequence having at least 90% sequence identity to SEQ ID NO: 360.

70. The base editor of paragraph 22, wherein the second monomer comprises the following structure: [SOD2]-$[UGI]_{1-2}$-[mitoTALE]-[$DddA_{tox}$-N of SEQ ID NO: 349 or $DddA_{tox}$-C of SEQ ID NO: 350]-$[UGI]_{1-2}$.

71. The base editor of paragraph 70, wherein the second monomer comprises an amino acid sequence of SEQ ID NO: 361, or an amino acid sequence having at least 90% sequence identity to SEQ ID NO: 361.

72. The base editor of paragraph 22, wherein the second monomer comprises the following structure: [COX8A]-$[UGI]_{1-2}$-[mitoTALE]-[$DddA_{tox}$-N of SEQ ID NO: 351 or $DddA_{tox}$-C of SEQ ID NO: 352]-$[UGI]_{1-2}$.

73. The base editor of paragraph 72, wherein the second monomer comprises an amino acid sequence of SEQ ID NO: 361, or an amino acid sequence having at least 90% sequence identity to SEQ ID NO: 361.

74. The base editor of any one of paragraphs 22-74, wherein the first and second monomers bind to first and second nucleotide sequences, respectively, on either side of a target site.

75. The base editor of paragraph 74, wherein the target site comprises a target base which becomes deaminated by the base editor.

76. The base editor of paragraph 75, wherein the target base is a C.

77. The base editor of paragraph 76, wherein the C is within a 5'-TC-3' sequence context.

78. The base editor of paragraph 76, wherein the C is within a 5'-TCC-3' sequence context, a 5'-CCC-3' context, a 5'-TCA-3' sequence context, or a 5'-TCT-3' sequence context.

79. The base editor of paragraph 74, wherein the nucleotide sequences are each on the same strand as the target base which becomes deaminated by the base editor.

80. The base editor of paragraph 75, wherein the first and second nucleotide sequences are each on the same strand as the strand comprising the target base which becomes deaminated by the base editor.

81. The base editor of paragraph 75, wherein the first and second nucleotide sequences are each on the opposite strand as the strand comprising the target base which becomes deaminated by the base editor.

82. The base editor of paragraph 75, wherein the first and second nucleotide sequences are each on the opposite strand as the strand comprising the target base which becomes deaminated by the base editor.

83. The base editor of paragraph 75, wherein the first and second nucleotide sequences are on opposing strands.

84. The base editor of any of paragraph 74, further comprising one or more guide RNAs if the first and/or second programmable DNA binding protein is a nucleic acid programmable DNA binding protein (napDNAbp), and wherein the one or more guide RNAs directs the base edit to bind to the first or second nucleotide sequence at the target site.

85. An isolated nucleic acid encoding the first monomer of the base editor of paragraph 22.

86. An isolated nucleic acid encoding the second monomer of the base editor of paragraph 22.

87. An isolated nucleic acid encoding the non-naturally occurring polypeptide variant of any of paragraphs 1-6.

88. An isolated nucleic acid encoding the non-naturally occurring polypeptide fragment of any of paragraphs 7-12.

89. A vector comprising the isolated nucleic acid of any one of paragraphs 85-88.

90. A cell comprising a vector of paragraph 89.

91. A method of editing a target nucleotide sequence at a target site, comprising contacting a target nucleotide sequence with a base editor of paragraphs 22-84, wherein the first monomer targets a first nucleotide sequence flanking a target site, and the second monomer targets a second nucleotide sequence flanking the target site, thereby inducing deamination of a target base at the target site.

92. The method of paragraph 91, wherein the target base is a C.

93. The method of paragraph 92, wherein the C is within a 5'-TC-3' sequence context.

94. The method of paragraph 92, wherein the C is within a 5'-TCC-3' sequence context, a 5'-CCC-3' context, a 5'-TCA-3' sequence context, or a 5'-TCT-3' sequence context.

95. The method of paragraph 91, wherein the programmable DNA binding protein of the base editor is a TALE, mitoTALE, zinc finger protein, or napDNAbp.

96. The method of paragraph 91, wherein the first and/or second programmable DNA binding protein of the base editor is a napDNAbp.

97. The method of paragraph 96, wherein the napDNAbp is a Cas9 domain.

98. The method of paragraph 96, wherein the napDNAbp is a nickase.

99. The method of paragraph 96, wherein the target nucleotide sequence is a mitochondrial sequence within a mitochondria.

100. The method of paragraph 96, wherein the napDNAbp is selected from the group consisting of: Cas9, Cas12e, Cas12d, Cas12a, Cas12b1, Cas13a, Cas12c, and Argonaute and optionally has a nickase activity.

101. The method of paragraph 96, wherein the napDNAbp comprises an amino acid sequence selected from the group consisting of SEQ ID NOs: 28, 31, 33, 35, 36-91, 353, and 354, or an amino acid sequence having at least 90% sequence identity to an amino acid sequence selected from the group consisting of: SEQ ID NOs: 28. 31, 33, 35, 36-91, 353, and 354.

102. The method of paragraph 91, wherein the first and/or second programmable DNA binding protein of the base editor is a mitoTALE.

103. The method of paragraph 102, wherein mitoTALE protein comprises an amino acid sequence selected from the group consisting of: SEQ ID NO: 1-12 or an amino acid sequence having at least 90% sequence identity with an amino acid sequence selected from the group consisting of SEQ ID NO: 1-12.

104. The method of paragraph 91, wherein the method further comprises contacting the target nucleotide sequence with guide RNAs if the programmable DNA binding protein of the base editor is a napDNAbp, wherein the guide RNAs direct the first and second monomers of the base editor to the target nucleotide sequence.

105. The method of paragraph 91, wherein the editing occurs in vivo.

106. The method of paragraph 91, wherein the editing occurs ex vivo.

107. The method of paragraph 91, wherein the target nucleotide sequence is a disease gene.

108. The method of paragraph 91, wherein the target nucleotide sequence is a disease gene in a mitochondria.

109. The method of paragraph 91, wherein the method of editing a nucleotide sequence results in the treatment of a mitochondrial disease.

110. The method of paragraph 91, wherein the mitochondrial disease is MELAS/Leigh syndrome and Leber's hereditary optic neuropathy.

111. A method of delivering a base editor of any of paragraphs 22-84 to a cell comprising transforming a cell with one or more vectors encoding the first and second monomers of the base editor, wherein once in the cell the first and second monomers are expressed and dimerize, thereby forming a base editor in the cell.

112. The method of paragraph 111, wherein the one or more vectors are viral expression vectors.

113. The method of paragraph 111, wherein one or more vectors are adeno-associated viral vectors (AAV) of any serotype.

114. The method of paragraph 111, further comprising the step of expressing a guide RNA in the cell if the first and/or second monomer comprise a napDNAbp, and wherein the guide RNA is expressed from the same vector or a different vector.

115. A method of delivering a base editor of any of paragraphs 22-84 to a mitochondria comprising transforming a cell with one or more vectors encoding the first and second monomers of the base editor, wherein once in the cell the first and second monomers are expressed, transported to the mitochondria, and dimerize therein, thereby forming a base editor in the mitochondria, wherein the first and second programmable DNA binding proteins of the base editor are mitoTALE domains.

116. The method of paragraph 115, wherein the one or more vectors are viral expression vectors.

117. The method of paragraph 115, wherein one or more vectors are adeno-associated viral vectors (AAV) of any serotype.

118. A therapeutic kit comprising one or more nucleic acid constructs, comprising:

(i) one or more nucleic acid sequences encoding the first and second monomers of the base editor of any of paragraphs 22-84.

(ii) a promoter that drives expression of (i).

119. The therapeutic kit of paragraph 118, further comprising an expression construct encoding one or more guide RNAs where either the first or second monomer comprises a napDNAbp.

EXAMPLES

Example 1: a Bacterial Double-Stranded DNA Cytidine Deaminase Toxin Enables RNA-Free Base Editing in the Mitochondrial Genome Background Bacterial toxins represent a vast reservoir of biochemical diversity that can be repurposed for biomedical applications. Many toxins function in interbacterial antagonism, yet their modes of action remain largely unknown. Here, the discovery, structure, biochemical characterization, and application of DddA, an interbacterial toxin that catalyzes the unprecedented deamination of cytidines within double-stranded DNA, is reported. All previously described cytidine deaminases, including those used in base editing, operate on single-stranded DNA and thus when used for genome editing require unwinding of double-stranded DNA by macromolecules such as CRISPR-Cas9 complexed with a guide RNA. The difficulty of delivering guide RNAs into the mitochondria has thus far precluded base editing in mitochondrial DNA (mtDNA). The ability of DddA to deaminate double-stranded DNA raises the possibility of RNA-free precision base editing, rather than simple elimination of targeted mtDNA copies following double-strand DNA breaks. Split-DddA halves were engineered that are nontoxic and inactive until brought together on target DNA by adjacently bound programmable DNA-binding proteins. Fusions of the split-DddA halves. TALE array proteins, and uracil glycosylase inhibitor resulted in RNA-free DddA-derived cytosine base editors (DdCBEs) that catalyze C•G-to-T•A conversions efficiently and with high DNA sequence specificity and product purity at targeted sites within mtDNA in human cells. DddA-mediated base editing was used to model a disease-associated mtDNA mutation in human cell lines, resulting in changes in rates of respiration and oxidative phosphorylation. CRISPR-free, DddA-mediated base editing enables precision editing of mtDNA, with important basic science and biomedical implications.

Enzymes that catalyze the deamination of cytidine and adenosine play pivotal roles in precision genome editing.[1,2] The biochemical and functional diversity of deaminases, however, remain largely unexplored. In particular, bacterial genomes contain a wide variety of uncharacterized cryptic deaminases,[3] raising the possibility that some may possess unique activities that could be exploited to enable new genome editing capabilities.

Inherited or acquired mutations in mitochondrial DNA (mtDNA) can profoundly impact cell physiology and are associated with a spectrum of human diseases, ranging from rare inborn errors of metabolism,[4] certain cancers,[5] age-associated neurodegeneration,[6] and even the aging process itself.[7,8] Tools for introducing specific modifications to mtDNA are urgently needed both for modeling diseases and for their therapeutic potential. The development of such tools, however, has been constrained in part by the challenge of transporting RNAs into mitochondria, including guide RNAs required to program CRISPR-associated proteins.[9]

Each mammalian cell contains hundreds to thousands of copies of a circular mtDNA[10]. Homoplasmy refers to a state in which all mtDNA molecules are identical, while heteroplasmy refers to a state in which a cell contains a mixture of wild-type and mutant mtDNA. Current approaches to engineer mtDNA rely on DNA-binding proteins such as transcription activator-like effectors nucleases (mitoTALENs)[11,17] and zinc finger nucleases (mitoZFNs)[18-20] fused to mitochondrial targeting sequences to induce double-strand breaks (DSBs). Such proteins do not rely on nucleic acid programmability (e.g., such as with Cas9 domains). Linearized mtDNA is rapidly degraded,[21-23] resulting in heteroplasmic shifts to favor uncut mtDNA genomes. As a candidate therapy however, this approach cannot be applied to homoplasmic mtDNA mutations[24] since destroying all mtDNA copies is presumed to be harmful.[22-25] In addition, using DSBs to eliminate heteroplasmic mtDNA mutations, which tend to be functionally recessive,[26] implicitly requires the edited cell to restore its wild-type mtDNA copy number. During this transient period of mtDNA repopulation, the loss of mtDNA copies could result in cellular toxicity.

A favorable alternative to targeted destruction of DNA through DSBs is precision genome editing, a capability that has not been reported for mtDNA. The ability to precisely install or correct pathogenic mutations, rather than destroy targeted mtDNA, could accelerate our ability to model mtDNA diseases in cells and animal models, and in principle could also enable therapeutic approaches that correct pathogenic mtDNA mutations.

a Predicted Deaminase Functions as an Interbacterial Toxin

Some predicted bacterial deaminases contain sequence hallmarks that suggest they are substrates for intercellular protein delivery systems.[3] These hallmarks include domains that direct transport through the type V I secretion system (T6SS).[3] The T6SS mediates antagonism between Gram-negative bacteria by catalyzing the direct transfer of antibacterial toxins into contacting cells.[27,28] Given their sequence divergence and potential functional differences from characterized deaminases, the biochemical activity of T6SS-associated deaminases were sought. Investigations were focused on a predicted deaminase (belonging to the SCP1.201-like family).[3] henceforth referred to as DddA, encoded by *Burkholderia cenocepacias* (B. cen) (FIG. 23A). A strain of B. cen lacking dddA and the downstream predicted immunity gene, which we named $dddI_A$, exhibited a marked growth defect when co-cultivated with the wild-type strain (FIG. 23B and FIGS. 28A-28C). The ΔdddA $\Delta ddd1_A$ strain did not display a growth defect in co-culture with a strain lacking activity of a T6SS (ΔicmF1) or expressing DddA bearing an amino acid substitution of a predicted deaminase catalytic residue ($dddA^{E1347A}$). These data establish DddA as a T6SS-delivered antibacterial toxin.

Members of the deaminase superfamily are known to catalyze deamination of single-stranded DNA (ssDNA), RNA (including mRNA and tRNA), free nucleosides, nucleotides, nucleobases, and other nucleotide derivatives[3]. To begin to define the substrate of DddA, which belongs to a clade of predicted deaminases lacking a characterized member[3], first whether or not deaminases representing the substrate range of the superfamily are toxic if ectopically expressed in bacteria was determined. The growth of *E. coli* was unaffected by production of deaminases that act on ssDNA, tRNA, or free cytidine (FIG. 23C). In contrast, DddA dramatically reduced the viability of *E. coli* (FIG. 23C and FIG. 28C). Amino acids 1264-1427 of DddA were identified as the domain that confers toxicity, referred to henceforth as $DddA_{tox}$. These findings suggested that DddA may act on a previously undescribed substrate of deaminases.

DddA is a Double-Stranded DNA-Specific Cytidine Deaminase

To further illuminate the substrate and mechanism of $DddA_{tox}$, we determined a 2.5-A resolution co-crystal structure of $DddA_{tox}$ bound to $DddI_A$ (Table 2). $DddA_{tox}$ adopts a typical deaminase fold consisting of a five-stranded β-sheet with buttressing helices that contribute critical catalytic residues to the active site (FIG. 23D). $DddI_A$, the immunity protein of DddA, contains a central antiparallel β-sheet that directly occludes the active site of $DddA_{tox}$, explaining the inhibitory activity of $DddI_A$ (FIG. 23D). Structure-based homology searches revealed APOBEC family enzymes as the closest structural relatives of $DddA_{tox}$, with notable divergence at the C-terminal β-strands of the two enzymes; these strands are antiparallel with an extended intervening loop in $DddA_{tox}$, versus parallel with an intervening α-helix in APOBEC enzymes (FIGS. 23D-23E).

Given the similarity of $DddA_{tox}$ and APOBEC proteins, the ability of $DddA_{tox}$ to catalyze the deamination of cytidine in vitro was tested. To date, all known DNA cytidine deaminases operate on ssDNA, often with a preference for the base immediately 5' of the substrate cytidine.[29] Therefore, the activity of $DddA_{tox}$ on a ssDNA substrate containing cytidine was measured in all four possible 5'-NC contexts. While the activity of APOBEC3A was readily detected, $DddA_{tox}$ did not catalyze uracil formation within ssDNA sequences (FIG. 23F). As a control, a related double-stranded DNA (dsDNA) substrate was included. Consistent with prior studies,[30] APOBEC3A did not display measurable activity against dsDNA. Unexpectedly, however, $DddA_{tox}$ efficiently converted cytidine to uracil within dsDNA (FIG. 23G). A mutant $DddA_{tox}$ in which we inactivated a predicted catalytic residue E1347A showed no uracil formation, indicating that deamination was dependent on $DddA_{tox}$ activity. Substrates of ssRNA or dsRNA were not detectably deaminated by $DddA_{tox}$ (FIGS. 29A-29B). These results collectively establish $DddA_{tox}$ as an unusual cytidine deaminase that operates on dsDNA but rejects ssDNA and RNA. The name $DddA_{tox}$ was derived based on these findings (double-stranded DNA deaminase toxin A). In light of these findings, we reexamined the $DddA_{tox}$ structure to gain insights into the unprecedented ability of the deaminase to act on dsDNA. Superimposition of $DddA_{tox}$ with an APOBEC3A-ssDNA complex suggests that cytidine is positioned similarly by the two enzymes, likely necessitating extrusion of the target cytidine from dsDNA (FIGS. 30A-30B), as observed in dsRNA-specific adenosine deaminases.[31]

If $DddA_{tox}$ converts cytidine to uracil specifically within dsDNA, it was reasoned that the enzyme should be mutagenic in a manner that is dependent on uracil DNA glycosylase (UDG), a protein that initiates base excision repair (BER) through uracil removal.[32,33] Indeed, expression of sub-lethal levels of $DddA_{tox}$ in *E. coli* substantially increased mutation frequency, and these mutagenic effects of $DddA_{tox}$ were enhanced >100-fold in an *E. coli* strain lacking UDG (FIG. 23H). An exploitation of the high mutational frequency incurred by sub-lethal $DddA_{tox}$ levels to profile the potential sequence context specificity of the enzyme was sought. Whole-genome sequencing was performed on five *E. coli* lineages that experienced serial $DddA_{tox}$ exposure and clonal bottlenecking, and five control strains that underwent a similar regimen in the presence of inactivated $DddA_{tox}$ (E1347A). Consistent with the mutation frequency measurements, ~50-fold more total SNPs were observed in strains exposed to active $DddA_{tox}$ (997) than strains producing the inactive enzyme (17), and >99% of the $DddA_{tox}$-dependent SNPs were C•G-to-T•A transitions (FIGS. 31A-31C). Alignment of sequences flanking the converted cytidine within these C•G-to-T•A mutations revealed a strong preference for 5'-TC contexts (FIG. 23I), which matches the substrate sequence preference of the enzyme in vitro (FIG. 31D). Together, these findings reveal that $DddA_{tox}$ deaminates dsDNA substrates in vitro and in bacterial cells with a preference for 5'-TC contexts, likely through cytosine extrusion.

Identifying Split $DddA_{tox}$ Halves that are Non-Toxic and Catalytically Competent Current base editors deaminate nucleotides in single-stranded DNA loops created by RNA-guided CRISPR proteins.[2,3-4,35] The ability of $DddA_{tox}$ to deaminate cytidines in dsDNA raises the possibility of using RNA-free programmable dsDNA-binding proteins such as zinc-finger arrays[36] or TALE arrays[37] to direct $DddA_{tox}$ to target cytidines in dsDNA. The resulting dsDNA cytosine base editor would enable base editing without requiring guide RNAs, raising the possibility of base editing in systems for which RNA delivery is prohibitive, such as the mitochondria.[9]

Consistent with experiments in *E. coli* (FIGS. 23B-23C), expression of $DddA_{tox}$ fused to programmable DNA-binding proteins was toxic to human HEK293T cells (FIGS. 40A-40C and the Supplementary Discussion section of Example 1). It was hypothesized that this toxicity could be avoided by splitting the protein into two inactive halves, one containing the N-terminus of $DddA_{tox}$ ($DddA_{tox}$-N), and the other containing the C-terminus ($DddA_{tox}$-C). Ideally, these halves would reconstitute deamination activity only when assembled adjacently on target DNA, analogous to the reassembly of FokI monomers to confer nuclease activity in ZFNs[38] and TALENs[37].

Based on the crystal structure of apo-$DddA_{tox}$, seven split sites within the loop regions of $DddA_{tox}$ were tested (FIG. 24A). Split variants were named to reflect the last residue of the $DddA_{tox}$-N half. Each $DddA_{tox}$ half was fused to the N-terminus of dSpCas9[39,40] or to an orthogonal engineered *S. aureus* SaKKH Cas9 variant (SaKKH-Cas9)[41] (FIG. 24B). To enhance editing efficiencies, SaKKH-Cas9(DOA) nickase[41,42] was used to nick the non-edited strand, thereby promoting resynthesis of the non-edited strand using the edited strand as a template, a strategy used during the development of base editors.[34,35,43,44] Each split was assayed in its two possible fusion orientations: SaKKH-Cas9 (D10A) fused to $DddA_{tox}$-N (referred to as the aureus-N orientation) or SaKKH-Cas9(D10A) fused to $DddA_{tox}$-C (referred to as the aureus-C orientation) (FIG. 24B). Dual binding of orthogonal $DddA_{tox}$-<dSpCas9 half and $DddA_{tox}$-SaKKH-Cas9(D10A) half to adjacent protospacers would in principle reconstitute functional $DddA_{tox}$ at target sites for cytidine deamination (FIG. 24C). The choice of protospacers was also varied to test split-$DddA_{tox}$ reassembly at target site spacing distances ranging from 12 to 60 bp in intervals of ~5-10 bp (FIGS. 41A-41C).

HEK293T cells were transfected with four plasmids: two plasmids encode $DddA_{tox}$-N or $DddA_{tox}$-C fused to either dSpCas9 or SaKKH-Cas9(D10A), and the remaining two plasmids encode two guide RNAs that direct the fusion proteins to flank a target TC (FIG. 24B). Genomic DNA was harvested three days post-transfection and analyzed by high-throughput DNA sequencing.

Among active split-$DddA_{tox}$ fusions, predominantly C•G-to-T•A conversions were observed in the intervening DNA sequence between the two protospacers. Editing efficiencies varied from 1.1% to 49% depending on the split site, split orientation and dsDNA spacing length (FIG. 24B and FIGS. 32A-32H). All editing efficiencies in this study report the fraction of sequenced alleles with the desired C•G-to-T•A edit among all treated cells with no enrichment or sorting. Importantly, it was observed that no on-target editing in the absence of guide RNAs (FIGS. 42A-42B) or when only one $DddA_{tox}$-Cas9 half and its guide RNA were present (FIG. 42B), indicating that editing is strictly dependent on the reassembly of both $DddA_{tox}$ halves at the Cas9-specified target site.

Out of the seven split sites tested, G1333 and G1397 yielded the highest editing efficiencies (FIGS. 32A-32H and the Supplementary Discussion section in Example 1), ranging from 22-48% maximal C•G-to-T•A conversion (FIGS. 32B, 32G, and 32H). For a given fusion orientation, the editing efficiencies of target bases were dependent on their positions within the spacing region: editing at a target $TC_{11}A$ within a 12-bp spacing region was 0.43±0.12% for G1397 aureus-N and 17±0.91% at a 17-bp spacing (FIG. 24D). Similarly, G1397 aureus-C yielded 20-22% editing efficiency at a target $TC_{14}T$ within 17- and 23-bp spacing regions and 41±2.1% within a 44-bp spacing region (FIG. 24D). These results collectively suggest that splitting $DddA_{tox}$ at G1333 and G1397 produce halves that can reconstitute a catalytically active deaminase capable of mediating efficient C•G-to-T•A conversion in human cells with appropriate spacing (~12-23 bp, or ~44-60 bp) between dual protospacers. Spacing length, target cytidine location within the dsDNA spacing region, and split orientation are all determinants of split $DddA_{tox}$ base editing efficiency.

TALE-Split-$DddA_{tox}$ Fusions Enable RNA-Free Base Editing

Despite the potential of mitochondrial DNA editing to illuminate mitochondrial biology and treat diseases that arise from mtDNA mutations, editing mtDNA has been hampered by the lack of an effective way to import RNA into the organelle[9]. This constraint has precluded the use of RNA-guided precision editing strategies such as base editing[34,35], as well as other CRISPR methods[43]. We speculated that we could use RNA-independent programmable DNA-binding proteins fused to split-$DddA_{tox}$ halves to enable RNA-free base editing of mtDNA. TALE proteins contain an array of highly conserved 33- or 34-amino acid repeats that each recognize a dsDNA nucleotide. Each repeat can be programmed to target A. C, G/A, or T nucleotides[45,46]. Arrays of TALE repeats recognize consecutive nucleotides of sufficient total length to specify a single dsDNA target sequence within a mammalian genome[47-49].

While deaminases have been previously fused to zinc-finger arrays and TALE arrays, the very low activity of previously described deaminases on dsDNA results in very low editing efficiencies (<2.5% in human cells) that are spread over >150 bp around the DNA-binding site[50]. Since our Cas9 fusion results indicate that $DddA_{tox}$ split at sites G1333 and G1397 deaminate target TC bases in dsDNA efficiently and in a manner that limits their activity to a modest spacing region (FIG. 24D and FIGS. 32A-32H), it was speculated that fusing halves from these two $DddA_{tox}$ splits to TALE array proteins programmed to bind neighboring DNA sites might result in selective and efficient RNA-free base editing in human cells. We limited DNA spacing lengths between the neighboring protospacers to 15-25 bp to minimize deamination of nearby bystander cytidines within the spacing region, and tested both split orientations to compare base editing efficiency and substrate selectivity.

Each TALE array was designed to target neighboring 17-bp sites within CCR5 in U20S cells and contained a bipartite NLS (bpNLS)[51,52] (FIG. 33A). Among the G1333 and G1397 splits tested, only the G1333 split with $DddA_{tox}$-N fused to the upstream (left-side) TALE (Left-G1333-$DddA_{tox}$-N+Right-G1333-$DddA_{tox}$-C) resulted in modest 3.6±0.70% editing efficiency at $C_9$ (the ninth nucleotide of the DNA spacing region between the two TALE array target sites) with 20±0.87% indels across 2- or 16-amino acid linkers (FIG. 33A).

We hypothesized that fusing uracil DNA glycosylase inhibitor (UGI) from *B. subtilis* bacteriophage PBS1 to the N- or C-terminus of each TALE-$DddA_{tox}$ fusion could suppress UDG-mediated nuclear base excision repair, a strategy we previously used to develop cytosine base editors[34,53,54]. Indeed, appending two copies of UGI (2x-UGI) to the N-terminus increased editing efficiency at $C_9$ by ~8-fold to 22-27%, and reduced indels to <2.3±0.31% (FIG. 33B). In contrast, fusing 2x-UGI to the C-terminus through a 2- or 16-amino acid linker resulting in lower editing efficiency of 12±3.5% or 3.3±1.3%, respectively (FIG. 33B). Tethering UGIs to the C-terminus of the $DddA_{tox}$ half may sterically hinder the deaminase, thereby impairing editing efficiencies. These results collectively demonstrate that G1333 and G1397 splits of $DddA_{tox}$ can be fused to TALE arrays by a 2-amino acid linker to mediate C•G-to-T•A conversions in the nucleus of human cells, and that fusing UGI to these proteins enhances editing efficiencies and reduces indel byproducts[34,53].

Optimizing TALE-Split $DddA_{tox}$ Fusions for Mitochondrial Base Editing

Given that TALE-split $DddA_{tox}$ fusions mediated efficient RNA-free base editing of nuclear DNA in human cells, we next investigated the possibility of applying this system to achieve programmable C•G-to-T•A conversion in mtDNA. We introduced previously reported mutations into the N-terminal domain (NTD)[55] of the 14459A-mitoTALE pair[11] to recognize wild-type ND6, a mitochondrial gene that encodes the NADH dehydrogenase 6 subunit of complex I. Each $DddA_{tox}$ half from a G1333 or G1397 split was fused to the C-terminus of the mitoTALE array protein through a 2-amino acid linker to form a mitoTALE-$DddA_{tox}$ pair that flanks a 15-bp mtDNA spacing region in HEK293T cells (FIG. 34A).

Among simple mitoTALE-$DddA_{tox}$ fusions (FIG. 34B), we observed the highest level of mtDNA target editing (4.9±0.17%) for the G1397 split containing $DddA_{tox}$-C fused to the right-side mitoTALE (Right-$DddA_{tox}$-C+Left-$DddA_{tox}$-N) (FIG. 34C). In contrast to nuclear-localized TALE-$DddA_{tox}$ (FIG. 33B), fusing one or two UGI proteins to the N-terminus of each mitoTALE-DddAto, half did not enhance C•G-to-T•A conversion (FIG. 25A). Appending one UGI to the C-terminus, however, increased editing levels by 3- to 10-fold compared to constructs lacking UGI. Using this Right-G1397-$DddA_{tox}$-C+Left-G1397-$DddA_{tox}$-N orientation, cytidines $C_6$, $C_7$, and $C_{13}$ (all in TC contexts) were edited with 27±2.1%, 32±2.5%, and 16±1.5% efficiencies (FIG. 25A), respectively, while $C_{11}$ in an AC sequence context that is disfavored by $DddA_{tox}$ (FIG. 23I) was edited less efficiently (4.4±0.39%). We speculate that UGI may be inhibiting the mitochondrial isoform UDG1[56], which was previously isolated from human mitochondria and shown to have uracil excision activity in vitro and in mitochondrial extracts[57-59]. Importantly, removing the mitochondrial targeting signal (MTS) sequences or replacing them with a bpNLS abrogated editing (FIG. 25A), suggesting that NIX editing is dependent on mitochondrial localization of the mitoTALE-$DddA_{tox}$ fusions (see the Supplementary Discussion section of Example 1).

Fluorescence microscopy revealed that while C-terminal MTS-mitoTALE-split-$DddA_{tox}$-UGI fusions clearly localized to the mitochondria in HeLa cells, N-terminal MTS-UGI-mitoTALE-split-$DddA_{tox}$ fusions remained diffused throughout the cytoplasm (FIG. 25B). These findings explain the observed dependence of editing efficiency on UGI fusion position, and suggest that the close proximity between the MTS and the N-terminal UGIs may impede mitochondrial translocation of the fusion protein.

In contrast with cytosine base editors for nuclear DNA[53], appending a second copy of UGI to the C-terminus of MTS-mitoTALE-split-$DddA_{tox}$-UGI did not increase mtDNA editing efficiencies for any tested target, despite exhibiting similar levels of mitochondrial localization (FIGS. 25A-25B). We speculate that adding a second UGI to the C-terminus may impede reassembly of split $DddA_{tox}$ into an active deaminase.

These results collectively suggested an optimized architecture for a mitoTALE-split-$DddA_{tox}$ pair in which each protein consists of (in N- to C-terminus order): an MTS, a TALE array, a 2-amino acid linker, a $DddA_{tox}$ half from the G1333 or G1397 split, and one UGI protein (FIG. 25C). This architecture, hereafter referred to as DddA-derived cytosine base editor (DdCBE), represents to our knowledge the first agent capable of performing targeted nucleotide conversions in mtDNA. This precision mtDNA editing capability contrasts with previously reported uses of TALE nucleases[11-13,16], zinc-finger nucleases[18-20] or restriction endonucleases[22,60] that make DSBs in mtDNA, which result primarily in copy number loss or heteroplasmic shifts in mtDNA[11-15,18,20,61].

Given that $DddA_{tox}$ can edit cytidines on either DNA strand, intermediates containing uracils on opposing DNA strands could produce DSBs following base excision repair, thereby resulting in unwanted indels. While BE4max targeting EMX1 in the nucleus resulted in 1.8±0.67% indels, typical of nuclear cytosine base editors, indels were not detected (<0.1%) at ND6 in HEK293T cells despite editing by ND6-DdCBE on both DNA strands (FIG. 25C). Similarly, in U2OS cells, indels were not detected at ND6 while CCR5-DdCBE targeting nuclear CCR5 yielded 3.7±0.74% indels (FIGS. 35A-35B). Indeed, we observed remarkably high product purities—the proportion of edited alleles that contain only the targeted C•G-to-T•A conversions—for DdCBE-mediated mtDNA base editing of ND6 in HEK293T cells (99.9±0.007%) and U2OS cells (99.5±0.22%), even beyond the product purities of BE4max (96±0.78%) and CCR5-targeting DdCBE (95±0.52%) when editing nuclear DNA (FIG. 25D and FIG. 35C).

Taken together, the very high product purity and lack of indels associated with DdCBE suggest that uracil repair processes that lead to indels and other byproducts in nuclear DNA[32] are inefficient in the mitochondria. This model is consistent with previous observations that a ssDNA deaminase targeted to the mitochondria introduced C•G-to-T•A conversions with no indels[62], supporting a model in mitochondria in which lesion-containing genomes are degraded rather than repaired[63,64], resulting in selective maintenance of mtDNA copies that have been cleanly edited.

We analyzed the ND6 allele distributions produced by ND6-DdCBE and found that alleles containing the $G_6G_7A$-to-$A_6A_7A$ conversion (which corresponds to a $TC_7C_6$-to-$TT_7T_6$ conversion in the complementary mtDNA strand) accounted for 38±0.90% of all edited alleles (FIG. 25E). Notably, $AC_{11}T$-to-$AT_{11}T$ conversion was present only in alleles that already had edits at the more readily edited TCC contexts (FIG. 23I), suggesting that $DddA_{tox}$ may operate processively. This behavior was not apparent in our bacterial genome mutational analyses, therefore it is likely to derive from tethering the enzyme to DNA (FIGS. 31A-31D).

Taken together, these findings establish a precise mtDNA editing capability that uses an unprecedented dsDNA-specific cytidine deaminase that we split to mitigate its toxicity, programmable dsDNA-binding TALE arrays, and a uracil glycosylase inhibitor to achieve efficient RNA-free base editing in the mitochondria.

Mitochondrial Base Editing of Five mtDNA Genes in Human Cells

To explore the generality of DdCBE for mtDNA editing, we constructed seven additional pairs of TALE array proteins either engineered de novo or adapted from validated mitoTALE arrays (Table 3) to target five mitochondrial genes: ND1, ND2, ND4, ND5, and ATP8. For some of the targeted sites, we expected DdCBE editing to install disease-relevant mutations (see the Supplementary Discussion section of Example 1). For example, C•G-to-T•A conversion by ND2- and ND4-DdCBE would install the m.5032G>A and m.11922G>A mutations, respectively, which are believed to be disease-causing in cancer-related tumors of the kidney and thyroid[5,65].

Mitochondrial base editing efficiencies of DdCBEs in HEK293T cells 3-6 days after treatment varied between 4.6-49% depending on the split type, split orientation, and target cytidine position within the spacing region (FIGS. 26A-26J). For DdCBEs using the G1333 split, those with $DddA_{tox}$-C fused to the right-side mitoTALE (Right-G1333-$DddA_{tox}$-C+Left-G1333-$DddA_{tox}$-N) resulted in 2.1- to 15-fold higher editing efficiencies than Right-G1333-$DddA_{tox}$-N+Left-G1333-$DddA_{tox}$-C, regardless of the spacing length and positions of TC target bases (FIGS. 26A-26E, and FIG. 26G).

In contrast, the effect of split orientation on editing efficiencies was more site-dependent for the G1397 split. The Right-G1397-$DddA_{tox}$-N+Left-G1397-$DddA_{tox}$-C orientation mediated 3.1- to 7.6-fold higher editing than the Right-G1397-$DddA_{tox}$-C+Left-G1397-$DddA_{tox}$-N orientation at $TC_{12}C$ within an 18-bp spacing region (FIGS. 26D-26E), but was 3.4-fold less efficient at converting $TC_{11}C$ within a 15-bp spacing region (FIG. 26F).

For a given TC target that was edited by both G1333 and G1397 splits, G1397 generally afforded higher editing efficiencies than G1333 (FIGS. 26A-26E). Collectively, optimized GI397-split DdCBEs mediated 42±2.5% average base editing efficiencies at four mtDNA sites (FIGS. 26A-26C, and FIG. 26E) and 9.0±0.92% average efficiencies at two other sites (FIGS. 26D and 26F), while the most efficient G1333-split DdCBEs yielded 43±2.2% average conversion at three sites (FIGS. 26A-26C) and 7.4±0.58% average efficiencies at three other sites (FIGS. 26D-26E, and FIG. 26G). In addition, we did not detect indels for the optimized G1333 and G1397 DdCBE orientations (FIGS. 45A-45B).

We observed a narrower editing window, which we define as the number of nucleotide positions upstream or downstream of the target TC base that are amenable to deamination, for G1397-split DdCBE compared to G1333-split DdCBE. The G1397 split efficiently converted TCs within a window of ~1-2 nucleotides positioned (i) approximately 4-7 nucleotides from the 3' end of a 15- to 18-bp spacing region in the H-strand of mtDNA (FIGS. 26A-26D, and FIG. 26F) or (ii) approximately 4 nucleotides from the 3' end of a 15-18 bp spacing region in the L-strand of mtDNA (FIG. 26C). In contrast, the G1 333 split converted TCs within a window of 3-5 nucleotides positioned approximately (i) 6-10 nucleotides from the 3' end of a 15- to 18-bp spacing region in the H-strand of mtDNA (FIGS. 26A-26C) or (ii) approximately 4 nucleotides from the 5' end of a 15- to 18-bp spacing region in the L-strand of mtDNA (FIG. 26A and FIG. 26G).

These results collectively suggest that each split is associated with a distinct preference for editing TCs within a specific editing window in the spacing region. We recommend testing G1397 and G1333 splits in both orientations to determine the fusion that gives the highest base editing efficiency for a given target sequence and spacing length.

To evaluate the durability of C•G-to-T•A mitochondrial DNA conversions in HEK293T cells, we tracked editing induced by ND6-, ND5.1-, ND5.2- and ATP8-DdCBE over 18 days at 3- or 6-day intervals, spanning approximately 21 cell divisions. Throughout this period, the viability of cells expressing DdCBEs remained indistinguishable from that of untreated cells (FIG. 36A). mtDNA editing did not produce large mtDNA deletions (FIG. 36B, FIG. 47 and the Supplementary Discussion section of Example 1) or alter mtDNA copy number (FIG. 36C).

Across all DdCBEs, editing efficiencies increased by 1.5- to 3.7-fold from day 3 to day 6 as levels of DdCBE protein persisted (FIGS. 37A-37F). DdCBE proteins were not detected by day 12 (FIG. 37F), but editing levels were generally maintained and sustained through the end of the experiment (day 18) (FIGS. 37A-37F and the Supplementary Discussion section of Example 1). By comparison, nuclear base editing of EMX1 by BE2 and BE4max peaked at day 3 and was generally maintained through day 18 (FIG. 37E and the Supplementary Discussion section of Example 1). We observed similar trends in the stability of C•G-to-T•A mtDNA edits in U20S cells (FIGS. 46A-46E).

We further characterized the ND4-DdCBE-edited HEK293T cells to evaluate the functional consequences of mtDNA editing of ND4. Following 8 days of passaging of three independently edited cell lines, we observed persistence of m.1 1922G>A heteroplasmic mutation in NI4 (FIG. 26H). Mitochondrial DNA homeostasis was intact based on assessment of mtDNA copy number and expression of mtDNA-encoded transcripts (FIGS. 38A-38B). In principle, the m.1 1922G>A ND4 mutation should disrupt complex I of the electron transport chain. Indeed, we observed decreased rates of oxidative phosphorylation (FIG. 26I), as well as basal and uncoupled respiration rates (FIG. 26J), in the edited cell lines compared to mock-edited cell lines.

Collectively, these results show that DdCBEs are capable of inducing durable. C•G-to-T•A conversions in mtDNA that are stably maintained (in the absence of edit-induced fitness changes) over many cell divisions without concomitant loss of cell viability and mtDNA copy number.

Off-Target Editing by DdCBEs

Virtually all genome editing agents reported to date exhibit some degree of editing at off-target loci, a consequence of the inherently imperfect nature of binding specificity, as well as the high sensitivity of modem genome analyses[1,2,66]. To profile potential off-target activity of DdCBE in the human mitochondrial genome, we transfected HEK293T cells with plasmids that constitutively expressed optimized DdCBE halves targeting ND6, ND5.1. ND5.2, ND4 or ATP8, or the corresponding inactive mutant DdCBE (dead-DdCBE) containing the E1347A mutation in $DddA_{tox}$. The dead-DdCBE controls enable identification of single-nucleotide variants (SNVs) that arise from background heteroplasmy to be distinguished from those that arise from off-target editing. To test for spontaneous assembly of split $DddA_{tox}$ in the absence of TALE-directed DNA binding, cells were also transfected with plasmids expressing $DddA_{tox}$ halves containing MTS-G1397 split $DddA_{tox}$-UGI, with no TALE array. Bulk cell populations were collected 3 days after transfection and sequenced by ATAC-seq[67-69] to capture the entire 16.6-kb mitochondrial genome with an average of ~5.100 to 9,900-fold coverage per mtDNA base (FIG. 27A and FIG. 47). High-confidence SNVs corresponded to >0.1% frequency in at least one biological replicate and were largely absent in the dead-DdCBE and untreated controls.

The average frequencies of genome-wide off-target C•G-to-T•A editing by ND5.2-DdCBE, ND4-DdCBE and ATP8-DdCBE were comparable to that of the untreated and TALE-free G1397 $DddA_{tox}$ controls (0.030-0.034% for the DdCBEs versus 0.029-0.030% for the controls), while ND5.1-DdCBE had 1.6-fold higher average off-target editing frequency (0.049%) compared to the untreated control (FIG. 27B). In general, the average off-target editing frequencies for these standard DdCBEs (ND5.1. ND5.2, ND4 and ATP8) were 150- to 860-fold lower than the average on-target editing frequencies (FIGS. 39B-39E). Overall, these results indicate that DdCBEs exhibit high ratios of on-target to off-target editing.

ND6-targeting DdCBE showed 4.2-fold higher average off-target editing frequency (0.13%) compared to that of the untreated control (FIG. 27B). We attribute the unusually high number of average off-target C-G-to-T•A conversions from ND6-DdCBE to its mutant NTD, which was engineered to be permissive for any DNA base at position $N_0$ (FIG. 25A). This mutant NTD may increase the non-specific binding activity of TALE array proteins, a feature of their two-state search mechanism that is distinct from site-specific DNA target recognition by TALE repeat domains[70].

Among the DdCBEs with standard NTDs, off-target editing levels did not strongly correlate with on-target editing efficiencies (compare FIG. 39B to FIG. 39D). Moreover, we observed that steady-state expression levels of DdCBEs are similar, and do not account for differences in DdCBE off-target activities (FIGS. 48A-48B and the Supplementary Discussion section of Example 1). The observations that off-target average editing frequencies and SNV numbers for TALE-free split G1937 $DddA_{tox}$ are comparable to those of untreated controls (FIGS. 27B-27C) suggest that off-target activity resulting from spontaneous reassembly of split $DddA_{tox}$ is negligible. Since all tested DdCBEs (with the exception of ND6-targeting DdCBE) share wild-type NTDs and the same deaminase domains, but contain different lengths and sequences of TALE repeat arrays, we conclude that TALE domains influence off-target DdCBE activity.

We noted a strong 5'-TC-3' preference across all tested DdCBEs that matched the sequence preferences for over-expression of free $DddA_{tox}$ in *E. coli* (compare FIG. 27D to FIG. 27I). More than 99% of the off-target SNVs in DdCBE-treated samples were C•G-to-T•A transitions (see Table 5 for list of all off-target SNVs, and the Supplementary Discussion section of Example 1) while SNVs in dead-DdCBE and untreated controls were a mixture of DNA transitions and transversions (FIG. 39F), suggesting that these off-target SNVs arise from DdCBE-mediated deamination rather than cell-specific heteroplasmy or somatic mutations.

To further probe the nature off-target edits by DdCBEs, we searched for sequence homology between 20-bp regions flanking each off-target edit and on-target TALE-binding sites. We did not observe any consensus off-target sequences that closely resemble on-target TALE binding sites (FIG. 27D). In addition, we noted a high percentage of overlapping SNVs (22% for ND6-DdCBE and >40-80% for ND5.1-, ND5.2-, ND4- and ATP8-DdCBEs) across samples treated with DdCBEs containing distinct TALE arrays programmed to bind different on-target sites (FIG. 27E and Table 6). Collectively, these results suggest that DdCBE-mediated off-target editing is TALE-dependent, but does not arise from canonical DdCBE editing at sequences similar to the on-target sites. Instead, we speculate that different TALE arrays experience different frequencies of engaging random DNA sequences[70-73], and DdCBEs that contain TALE arrays with higher non-specific DNA binding activity may induce higher frequencies of deamination at off-target sequences.

Discussion

This study describes the discovery of a dsDNA-specific cytidine deaminase toxin, and its development into an RNA-free base editor that can install the first targeted point mutations in the human mitochondrial genome. Additional research will be needed to fully elucidate the principles governing DdCBE efficiency and specificity. Given that $DddA_{tox}$ activity can be attenuated by the $DddI_A$ immunity protein, this built-in kill switch could be used to control DdCBE activity if necessary. In addition, developing in vitro and in vivo strategies to deliver DdCBEs will be essential for exploring their therapeutic potential in other cell types and in animal models of mitochondrial diseases. Evolving or engineering $DddA_{tox}$ variants with altered sequence context preferences beyond 5'-TC-3'[74], or that deaminate nucleosides other than cytidine[35], would further expand the scope of mtDNA editing. The largely untapped natural diversity of bacterial DNA deaminases could provide additional starting points towards these and other novel base editing systems.

Editing of mitochondrial DNA has previously been limited to heteroplasmy shifts[75] or copy number modulation[76] due to the lack of DSB-initated DNA repair pathways found in the nucleus, and the unavailability of reliable methods to import guide RNAs required for CRISPR methods. Following our discovery of an interbacterial toxin $DddA_{tox}$ that unprecedentedly deaminates cytidines only in dsDNA, we designed splits of $DddA_{tox}$ to overcome its inherent toxicity and engineered fusions of the non-toxic halves to DNA-binding TALE proteins. The resulting DdCBEs enable programmable C•G-to-T•A conversions in mtDNA without requiring DSBs, a new capability that has the potential to install or correct pathogenic mtDNA SNPs associated with mitochondrial disorders (FIG. 50 and Table 7) and expand our knowledge about mitochondrial biology.

More broadly, the principles behind DdCBE demonstrate how enzymes that modify double-stranded DNA can be made dependent on DNA-binding proteins to enable efficient CRISPR-free gene editing systems. Finally, while this study has focused on the use of DdCBE for mitochondrial base editing, some features of DdCBE (or zinc-finger array variants), such as its all-protein nature, lack of a PAM requirement, and independence from CRISPR components, may also offer advantages for base editing outside the mitochondria.

Methods

Bacterial Strains and Culture Conditions

Except as noted, all bacterial strains used in this study were grown in Lysogeny Broth (LB) at 37° C. When required, media was supplemented with the following: carbenicillin 150 μg mL-1 gentamycin μg $mL^{-1}$, 80 μM IPTG, 0.05% (w/v) rhamnose, chloramphenicol μg mL-1 or tetracycline μg mL-1 for *E coli*, chloramphenicol 15 μg $mL^{-1}$ or gentamycin 30 μg mL-1 for *P. aeruginosa*, and carbenicillin 150 μg mL-1, or tetracycline 120 μg mL-1 for *B. cenocepacia. E. coli* strains DH5α, XK1502, and BL21 were used for plasmid maintenance, toxicity and mutagenesis assays, and protein expression, respectively. *P. aeruginosa* strains were derived from the model strain PAO1, and *B. cenocepacia* strains were derived from the cystic fibrosis clinical isolate H111. A detailed description of the bacterial strains and plasmids used in this study is provided in Tables 8A-8B.

Genetic Techniques and Plasmid Construction for Bacterial Expression

All procedures for DNA manipulation and transformation were performed with standard methods. Molecular biology reagents, PHUSION® high fidelity DNA polymerase, restriction enzymes, UDG, and Gibson Assembly Reagent were obtained from New England Biolabs (NEB). GoTaq® Green Master Mix was obtained from Promega. Primers and gBlocks used in this study were obtained by Integrated DNA Technologies (IDT). A list of all primers is provided in the Supplementary Sequence section in Example 1.

Protein expression constructs were generated by Gibson assembly. For functional protein expression assays of $DddA_{tox}$, TadA and CDD, the relevant genes or gene fragments were amplified from *B. cenocepacia* ($DddA_{tox}$) or *E. coli* genomic DNA and cloned into the vector pSCRhaB2. $DddA_1$ was amplified from *B. cenocepacia* and cloned into pPSV39, and the expression construct for $DddA_{tox}$ (E1347A) was generated by splicing by overlap extension PCR followed by Gibson assembly with pSCRhaB2. For the APOBEC3G expression construct, the gene sequence was codon optimized for expression in *E. coli*, generated by synthesis as a gBLOCK (IDT) and cloned into pSCRhaB2. For protein purification, $DddA_{tox}$ and $DddA_1$ were amplified from *B. cenocepacia* and cloned into pETDuet.

Deletion of udg in *P. aeruginosa* was performed using allelic exchange mediated by the vector pEXG2, using counter selection with sucrose as described in detail previously[79]. Gene deletions and nucleotide substitutions in *B. cenocepacia* were performed by homologous recombination using the plasmid pDONRPEX18Tp-SceI-pheS, followed by counter selection using the plasmid pDAI-SceI and plasmid curing using 0.1% (w/v) p-chlorophenylalanine, as described previously[80]. Gentamycin resistant *B. cenocepacia* was generated by insertion of a resistance cassette at the Tn7 site attachment site as described previously[81].

Plasmid Construction for Mammalian Expression

PCR was performed using PHUSION® U Green Multiplex PCR Master Mix (ThermoFisher Scientific), PHUSION® U Green Hot Start DNA Polymerase (ThermoFisher Scientific) or Q5 Hot Start High-Fidelity DNA Polymerase (New England Biolabs). All plasmids were constructed using USER cloning (New England Biolabs). $DddA_{tox}$ and mitoTALE genes were synthesized as gene blocks and codon optimized for human expression (Genscript). BE2 and BE4max plasmids were obtained from previous reports[34,54]. $DddA_{tox}$-Cas9 fusions and DdCBE variants were cloned into pCMV (mammalian codon-optimized) backbones, sgRNA plasmids were constructed by blunt-end ligation of a linear polymerase chain reaction (PCR) product generated by encoding the 20- to 23-nt variable protospacer sequence onto the 5' end of an amplification primer and treating the resulting piece with KLD Enzyme Mix (New England Biolabs) according to the manufacturer's instruction. Mach1 chemically competent *E. coli* cells (ThermoFisher Scientific) were used for plasmid construction. Plasmids for mammalian transfection were purified using ZYMOPURE™ II Plasmid Midiprep Kits (Zymo Research), as previously described[82]. A list of all primers is provided in the Supplementary Sequence section of Example 1.

Bacterial Competition Experiments

Donor and recipient strains were grown overnight and mixed in a 10:1 (v/v) ratio for donor and recipient, respectively. The cell suspensions were then concentrated to a total $OD_{600}$ of 10, and 10 μL was spotted on a 0.2 μm nitrocellulose membrane placed on LB with 3% (w/v) agar followed by 6 hours incubation at 37° C. After the incubation, cells were scraped from the membranes surface and resuspended in 1 mL LB. The initial donor:recipient ratio and the post-incubation ratio were determined by plating on LB agar (LBA) to determine the total number of colony forming units (CFU) and on LBA to with gentamycin to determine CFUs for the marked recipient strain. The competitive index is defined as the final donor:recipient ratio divided by the initial donor:recipient ratio. Competition experiments used to determine the bactericidal effect of DddA were performed similarly, but instead of cells being plated after 6 hours, they were harvested and plated hourly and CFU were enumerated on LBA with gentamycin to quantify the recipient strain population.

Toxicity Assays

To evaluate the toxicity of deaminases expressed heterologously, overnight cultures of *E. coli* XK1502 containing the appropriate plasmids were diluted 1:1000 into fresh medium and grown until reaching exponential phase ($OD_{600}$ 0.6), at which point deaminase expression was induced with 0.2% (w/v) rhamnose. Aliquots of cultures were then collected periodically until 480 minutes of growth, and were diluted and plated onto LBA for CFU determination.

Crystallization and Structure Determination

Crystals of the selenomethionine derivative hexahistidine-tagged $DddA_{tox}$ (a.a. 1264-1427). $DddA_1$ complex were obtained at 5-10 mg/mL in crystallization buffer (15 mM Tris pH 7.5, 150 mM NaCl, 1.0 mM tris(2-carboxyethyl)phosphine (TCEP)), mixed 1:1 with crystallization solution containing 25% (w/v) PEG 3350, 0.1 M Bis-Tris: HCl pH 6.5, 200 mM $MgCl_2$. Rectangular crystals grew to 400×200×100 μm over 5 days. Selenomethionine $DddA_{tox}$. $DddA_i$ crystals displayed the symmetry of space group $P2_12_12$ (a=126.8 Å, b=145.0 Å, c=64.2 Å, α=Θ=γ=90°), with four dimers in the asymmetric unit. Prior to data collection, crystals were cryoprotected in crystallization solution 15% glycerol, 25% PEG3350, 100 mM $MgCl_2$, 100 mM NaCl, 7.5 mM Tris pH 7.5, 50 mM Bis-Tris pH 6.5, 0.5 mM TCEP.

Highly redundant anomalous (SAD) data were obtained at 0.9790 Å (peak) wavelength from a single selenomethionine crystal at 100 K temperature at the BL502 beamline (ALS, Lawrence Berkeley National Laboratory). Data were processed using HKL2000[83]. Heavy atom searching using phenix.autosol identified 18 possible sites, and refinement yielded an estimated Bayes correlation coefficient of 55.9 to 2.5 Å resolution. After density modification, the estimated Bayes correlation coefficient increased to 61.2. Approximately 70% of the selenomethionine model was constructed automatically, and the remaining portion was built manually. The current model (Table 2) contains four DddA·Dddl$_A$ dimers.

Refinement was carried out against peak anomalous data with Bijvoet pairs kept separate using phenix.refine[84] interspersed with manual model revisions using the program Coot[85] and consisted of conjugate-gradient minimization and calculation of individual atomic displacement and translation/libration/screw parameters[86]. Residues that could not be identified in the electron density were: 1250-1289 and 1423-1427 for DddA, and 71-73 for Dddl$_A$. Both models exhibit excellent geometry, as determined by MolProbity[87]. Ramachandran analysis identified 99.1% favored. 0.9% allowed, and 0% disallowed residues for the model. Coordinates and structure factors are deposited in the RCSB Protein Data Bank (ID 6U08).

Mutation Frequency Determination and SNP Generation Assay

To determine the frequency of mutations induced by expression of DddA$_{tox}$ and DddA$_{tox}$ (E1347A), overnight cultures of *E. coli* containing the expression plasmids for these proteins together with the plasmid for expression of DddA$_I$ were diluted 1:1000 into fresh medium and grown until reaching exponential phase (OD$_{600}$ 0.6). The cultures were then induced with 0.08 mM IPTG for Dddl$_A$ and 0.04% rhamnose for DddA$_{tox}$ or DddA$_{tox}$ (E1347A) expression respectively. The combined expression of both toxin and immunity proteins at this low level allows the cells expressing DddA$_{tox}$ to suffer growth arrest but does not result in a decrease in culture viability. After 1 hour under these inducing conditions, cultures were supplemented with 1 mM of IPTG to increase Dddl$_A$ expression and thus block DddA toxicity and were then grown an additional 16 hours. After this recovery period, the cultures were plated onto LBA containing rifampicin or no antibiotics. Mutation frequency was determined by the ratio of the number of rifampicin resistant colonies by the total CFU obtained on non-selective medium.

For the genome-wide identification of SNPs that accumulate following low level expression of DddA$_{tox}$ or DddA$_{tox}$ (E1347A), *E. coli* Δudg carrying plasmids for expression of one of these proteins plus the plasmid for expressing Dddl$_A$ was submitted to seven rounds of expression and recovery as described above, with cultures being plated after recovery and single colonies being selected and used to inoculate the subsequent round of expression. Randomly chosen single colonies were used to avoid introducing selection for increased fitness under the culture conditions[87]. Five isolated colonies from each starting population subjected to this regimen were selected for whole genome sequencing.

Western Blot for *E. coli*-Expressed Deaminase

Western blotting to detect deaminases expressed in *E. coli* was performed using rabbit α-VSV-G (diluted 1:5000, Sigma) and detected with α-rabbit horseradish peroxidase-conjugated secondary antibodies (diluted 1:5000, Sigma). Loading control was performed with mouse α-RNAP (diluted 1:500. Biolegend) and detected with sheep α-mouse (diluted 1:500, Millipore). Western blots were developed using chemiluminescent substrate (SuperSignal West Pico Substrate, Thermo Scientific) and imaged with a C600 imager (Azure biosystems).

Western Blot for Mammalian Cell-Expressed DdCBIE

HEK293T cells were transfected as described below. For preparation of cell lysate for western blot analysis of DdCBE, cells were lysed in 150 μL of ice-cold 1×RIPA buffer (Sigma) with added protease inhibitor (Roche Complete Mini) by incubating for 30 min at 4° C. with agitation. Lysates were cleared by pelleting at 12,000 rcf for 10 min at 4° C.

60 μL of cleared lysate supernatant was added to 20 μL of 4X LDS sample loading buffer (ThermoFisher Scientific) with a final DTT (Sigma Aldrich) concentration of 10 mM. Lysates were boiled for 10 min at 95° C. 15-20 p L of protein lysate was loaded into the wells of a Bolt 4-12% Bis-Tris Plus (Thermo Fisher Scientific) pre-cast gel. 6 μL of Precision Plus Protein Dual Color Standard (Bio-Rad) was used as a reference. Samples were separated by electrophoresis at 180 V for 35 min in Bolt MES SDS running buffer (Thermo Fisher Scientific). Transfer to a PVDF membrane was performed using an iBlot 2 Gel Transfer Device (Thermo Fisher Scientific) according to manufacturer's protocols. The membrane was blocked in Odyssey Blocking Buffer (LI-COR) for 1 h at room temperature, then incubated with rat anti-FLAG (ThermoFisher Scientific MA1-142: 1:2000 dilution), mouse anti-HA (ThermoFisher Scientific 26183: 1:2000 dilution) and rabbit anti-actin (CST 4970; 1:2000 dilution) in blocking buffer (0.5% Tween-20 in lxPBS, 0.2 μm filtered) overnight at 4° C. The membrane was washed 3× with TBST (1xTBS in 0.5% Tween-20) for 10 min each at room temperature, then incubated with IRDye-labeled secondary antibodies goat anti-rat 680RD (LI-COR 926-68076), goat anti-mouse 800CW (LI-COR 926-32210) and donkey anti-rabbit 800CW (LI-COR 926-32213) diluted 1:5000 in blocking buffer for 1 h at room temperature. The membrane was washed as before, then imaged using an Odyssey Imaging System (LI-COR).

Purification of Proteins for Biochemical Assays

Overnight cultures of *E. coli* BL21 pETDuet-1::dddA$_{tox}$-dddA$_1$, or *E. coli* BL21 pETDuet-1::dddA$_{tox}$ (E1347A) were used to inoculate 2 L of LB broth in a 1:100 dilution and cultures were grown to approximately OD$_{600}$ 0.6. At this point, plasmid expression was induced with 0.5 mM IPTG and the cultures were incubated for 16 hours at 18° C. in a shaking incubator. Cell pellets were harvested by centrifugation at 4000 g for 20 min, followed by resuspension in 50 mL of lysis buffer (50 mM Tris-HCl pH 7.5, 500 mM NaCl, 30 mM imidazole, 1 mM DT., and 1 mg/mL lysozyme). Cell pellets were then lysed by sonication (5 pulses, 10 s each) and supernatant was separated by centrifugation at 25,000 g for 30 min.

The DddA$_{tox}$-DddA$_1$ complex or DddA$_{tox}$ (E1347A) was purified from cell lysates by nickel affinity chromatography using 4 mL of Ni-NTA agarose beads loaded onto a gravity-flow column. Supernatant was loaded onto the column and resin was washed with 50 mL of wash buffer (50 mM Tris-HCl pH 7.5, 500 mM NaCl, 30 mM imidazole, 1 mM DTT). Proteins of interest were eluted with 5 mL elution buffer (50 mM Tris-HCl pH 7.5, 300 mM Imidazole, 500 mM NaCl. 30 mM imidazole, 1 mM DTT). When DddA$_{tox}$ (E1347A) was purified, the eluted samples were applied directly to size exclusion chromatography. For DddA-DddA$_1$, the eluted samples underwent a denaturation and renaturation step to isolate only the toxin. In this case, the eluted proteins were added to 50 mL 8 M urea denaturing buffer (50 mM Tris-HCl pH 7.5, 300 mM Imidazole, 500 mM NaCl, and 1 mM DTT) and incubated for 16 hours at 4° C. The 8 M urea denaturing buffer with the eluted proteins was loaded on a gravity-flow column with 4 mL Ni-NTA agarose beads. The column was washed with 50 mL 8 M urea denaturing buffer to remove any remaining $DddA_1$. While still bound to Ni-NTA agarose beads. $DddA_{tox}$ was renatured by sequential washes with 25 mL denaturing buffer with decreasing concentrations of urea (6 M, 4 M, 2 M. 1 M), and a last wash with wash buffer to remove remaining traces of urea. Proteins bound to the column were then eluted with 5 mL elution buffer. The eluted samples were purified again by sizing exclusion chromatography using protein liquid chromatography (FPLC) with gel filtration on a SUPERDEX®200 column (GE Healthcare) in sizing buffer (20 mM Tris-HCl pH 7.5, 200 mM NaCl, 1 mM DTT, 5% (w/v) glycerol). The fraction purity was evaluated by SDS-PAGE gel stained with Coomassie Brilliant Blue and the highest quality factions were stored at −80° C.

DNA Deamination Assays

All the DNA substrates were designed with the addition of a 5' 6-FAM fluorophore for visualization, and they were purchased from Integrated DNA Technologies (IDT). All substrate sequences are present in the Supplementary Sequence section of Example 1. Reactions were performed in 10 μL of deamination buffer (20 mM MES pH 6.4, 200 mM NaCl, 1 mM DTT, 8% Ficoll 70, and 1 μM substrate) with APOBEC3A, $DddA_{tox}$ or $DddA_{tox}$ (E1347A) at the concentrations indicated in FIG. 1. Reactions were incubated for 1 hour at 37° C., followed by the addition 5 μL of UDG solution (New England Biolabs, 0.02 U/μL UDG in 1X UDG buffer) and further incubation for 30 minutes. Cleavage of substrates was induced by addition of 100 mM NaOH and incubation at 95° C., for 3 minutes. Samples were analyzed by denaturing 15% acrylamide gel electrophoresis and the resulting fluorescent DNA fragments were detected by imaged with a C600 (Azure biosystems).

Poisoned Primer Extension Assay for RNA Deamination

All substrate sequences are listed in the Supplementary Sequence section of Example 1. The RNA substrates and the oligonucleotide containing a 5' 6-FAM fluorophore for visualization were purchased from Integrated DNA Technologies (IDT). Deamination reactions were performed in 10 μL of RNA deamination buffer (Tris-HCl pH 7.5. 200 mM NaCl, 1 mM DTT) with the addition of 1 μM of $DddA_{tox}$ or $DddA_{tox}$(E1347A). Substrate combinations and concentrations were added as indicated in FIGS. 29A-29B, and reactions were incubated for 1 hour at 37° C. cDNA synthesis was performed in a 10-μL reaction (2.5 U/μL MultiScribe™ Reverse Transcriptase (ThermoFisher), 1 μL deamination reaction, 1.5 μM oligonucleotide, 100 μM dATP, 100 μM dCTP, 100 p M dTTP, and 100 μM ddGTP). The reaction was incubated at 37° C., for 10 minutes and samples were analyzed by denaturing 15% acrylamide gel electrophoresis. The synthesized cDNA fragments were detected by fluorescence imaging with a C600 (Azure biosystems).

Genome Sequencing and SNP Identification in Bacteria

Overnight cultures from isolated colonies were used for total gDNA extraction with the DNeasy Blood & Tissue kit (Qiagen), and extraction yield was quantified using a QUBIT®. Sequencing libraries were constructed using the Nextera DNA Flex Library Prep Kit (Illumina). Library quality and concentration was evaluated with a QUBIT® and TapeStation System (Agilent). Sequencing was performed with an Illumina MiSeq instrument (300 cycles paired end program). Genome mapping was performed with BWA[88] using the *E. coli* MG1655 (NC_000913.3) genome as a reference. Pileup data from alignments were generated with SAMtools and variant calling was performed with VarScan2[89]. SNPs were considered valid if they were present at a frequency higher than 90%.

Mammalian Cell Culture

All cells were cultured and maintained at 37° C. with 5% $CO_2$. Antibiotics were not used for cell culture. HEK293T cells [CRL-3216. American Type Culture Collection (ATCC)] were cultured in Dulbecco's modified Eagle's medium plus GlutaMax (Thermo Fisher Scientific) supplemented with 10% (v/v) fetal bovine serum (FBS). U20S cells (HTB-96, ATCC) were cultured in MyCoy's 5A medium plus GlutaMax (Thermo Fisher Scientific) supplemented with 10% (v/v) FBS. HeLa cells (ATCC CCL-2) were cultured in high glucose DMEM (Gibco) with 10% fetal bovine serum (Atlanta Biological), and 100 U/mL penicillin (Sigma-Aldrich). Cell lines were authenticated by their respective suppliers and tested negative for mycoplasma.

Mammalian Cell Lipofection

HEK293T cells were seeded on 48-well collagen-coated plates (Corning) at a density of $2\times10^5$ cells/mL 18-24 hours before lipofection. Lipofection was performed at a cell density of approximately 70%. For split $DddA_{tox}$-Cas9 screening, cells were transfected with 375 ng of split $DddA_{tox}$-dSpCas9 monomer expression plasmid, 375 ng of split DddAkto-SaKKH-Cas9(D10A) monomer expression plasmid, 125 ng of SpCas9 gRNA expression plasmid and 125 ng of SaKKH gRNA plasmid, pUC19 was used as a filler DNA for monomer and no-gRNA control experiments to make up to 1000 ng of total plasmid DNA. For DdCBE experiments, cells were transfected with 500 ng of each mitoTALE monomer to make up 1000 ng of total plasmid DNA. LIPOFECTAMINE® 2000 (1.5 μL: ThermoFisher Scientific) was used per well. Cells were harvested at the indicated timepoint.

For western blot analysis of DdCBEs expressed in mammalian cells, HEK293T cells were seeded on 6-well tissue culture-treated plates (Corning) at a density of $2\times10^5$ cells/mL 18-24 hours before lipofection. Cells were transfected with 4000 ng of each mitoTALE monomer to make up 8000 ng of total plasmid DNA. LIPOFECTAMINE® 2000 (12 μL: ThermoFisher Scientific) was used per well. Cells were harvested at the indicated timepoint.

For inducible expression of full-length $DddA_{tox}$ fused to Cas9 (FIGS. 40A-40C), doxycycline hyclate (Millipore Sigma) was freshly prepared and added directly to cells ~4-5 h after transfection to a final concentration of 0.1 μg/mL.

Mammalian Cell Nucleofection

We combined 500 ng of Left DdCBE monomer and 500 ng of Right DdCBE monomer in a volume that did not exceed 2 μL. This combined plasmid mixture was nucleofected in a final volume of 22 μL per sample in a 16-well NUCLEOCUVETTE® strip (Lonza). U20S cells were nucleofected using the SE Cell Line 4D-Nucleofector X Kit (Lonza) with 30,000-50,000 cells per sample (program DN-100), according to the manufacturer's protocol.

Cell Viability Assays

Cell viability was measured every either every 24 h post-transfection for 3 days (FIG. 40B) or every 3 to 6-days over an 18-day time course (FIG. 36A) using the CELLTITER-GLO® 2.0 assay (Promega) according to the manufacturer's protocol. Luminescence was measured in 96-well flat black-bottomed polystyrene microplates (Corning) using a M1000 Pro microplate reader (Tecan) with a 1-s integration time.

Genomic DNA Isolation from Mammalian Cell Culture

Medium was removed, and cells were washed once with 1× Dulbecco's phosphate-buffered saline (ThermoFisher Scientific). Genomic DNA extraction was performed by addition of 45 μL freshly prepared lysis buffer (10 mM tris-HCl (pH 7.0), 0.05% SDS, and proteinase K (20 μg/mL; ThermoFisher Scientific)) directly into the 48-well culture well. The extraction solution was incubated at 37° C., for 60 min and then 80° C., for 20 min. Resulting genomic DNA was subjected to bead cleanup with AMPure DNAdvance beads according to manufacturer's instructions (Beckman Coulter A48705).

Determination of Relative Total Mitochondrial DNA Levels by Quantitative PCR

Quantitative PCR (qPCR) reactions were performed on a Bio-Rad CFX96/C1000 qPCR machine performed using SYBR® green (Lonza). 5 ng of purified DNA was used as template input in a 25 μL reaction volume. For all reactions, the protocol used was an initial heating step of 2 min at 98° C. followed by 40 cycles of amplification (10 s at 98° C. 20 s at 62° C., 15 s at 72° C.). Single threshold values (AC) were determined by manufacturer's software. The level of mtDNA was determined by the calculating the ratio of total mtDNA to genomic DNA (β-actin)

$$\left(\text{Ratio} = \frac{(E_{mtDNA})^{\Delta C_{mtDNA}(DdCBE-dead\ DdCBE)}}{(E_{\beta-actin})^{\Delta C_{\beta-actin}(DdCBE-dead\ DdCBE)}},\right.$$

where E is the efficiency of the qPCR reaction: $E_{ND6}$=0.858, $E_{ND5}$=0.844, $E_{ATP8}$=0.995, $E_{\beta\text{-}actin}$=1.05). Refer to the Supplementary Sequence section of Example 1 for list of primers used. NC_012920 was used as the reference for mtDNA; NG_003019 was used as the reference for human ACTBP2.

Long-Range PCR to Detect mtDNA Deletions

Long-range PCR was performed on purified genomic DNA as previously with listed primers (Supplementary Sequence section of Example 1) to capture the whole mtDNA genome as two overlapping fragment of ~8 kb each. Briefly, ~50-200 ng of purified DNA was used as input for amplification by PRIMESTAR GXL DNA polymerase (Takara). For all reactions, the protocol used was an initial heating step of 1 min at 94° C. followed by 30 cycles of amplification (30 s at 98° C. 30 s at 60° C., 9 min at 72° C.). Unpurified PCR products were run on 0.8% agarose gel and stained with ethidium bromide.

Immunocytochemical Studies of DdCBE Localization

HeLa cells were transfected with a total of 1 μg of plasmid DNA to express left (HA-tagged) or right (FLAG-tagged) monomers of each DdCBE using LIPOFECTAMINE® 3000 (Invitrogen) according to the manufacturer's protocol. After 24 hours incubation, cells were labelled with MitoTracker Deep Red (ThermoFisher) at a final concentration of 100 nM for 30 minutes at 37° C., 5% $CO_2$ incubator. Cells were then seeded on an 8-well chamber glass slide (Ibidi) and fixed in 4% paraformaldehyde/PBS for 15 minutes at room temperature. Next, cells were washed twice with PBS and permeabilized in PBS containing 0.1% saponin and 1% BSA for 30 minutes at room temperature. Cells were then immunostained with α-HA (Biolegend) or α-Flag (Sigma Aldrich), followed by ALEXA FLUOR® conjugated α-mouse (HA tag) or α-rabbit (FLAG tag) secondary antibodies (Thermo Fisher). Images were taken using a 60× objective with the high-resolution widefield Nikon system. Acquired images were processed in Fiji (fiji.sc).

High-Throughput DNA Sequencing of Genomic DNA Samples

Genomic sites of interest were amplified from genomic DNA samples and sequenced on an Illumina MiSeq as previously described with the following modifications[43]. Amplification primers containing Illumina forward and reverse adapters (Supplementary Sequence section of Example 1) were used for a first round of PCR (PCR 1) to amplify the genomic region of interest. Briefly. 1 μL of purified genomic DNA was input into the first round of PCR (PCR1). For PCR 1. DNA was amplified to the top of the linear range using PHUSION® Hot Start II High-Fidelity DNA Polymerase (ThermoFisher Scientific), according to the manufacturer's instructions but with the addition of 0.5×SYBR@Green Nucleic Acid Gel Stain (Lonza) in each 25-μL reaction. For all amplicons, the PCR1 protocol used was an initial heating step of 2 min at 98° C. followed by an optimized number of amplification cycles (10 s at 98° C., 20 s at 62° C., 30 s at 72° C.). Quantitative PCR was performed to determine the optimal cycle number for each amplicon. The number of cycles needed to reach the top of the linear range of amplification are ~27-28 cycles for nuclear DNA amplicons and ~17-19 cycles for mtDNA amplicons. Barcoding PCR2 reactions (25 μL) were performed with 1 μL of unpurified PCR1 product and amplified with Q5 Hot Start MasterMix (New England Biolabs) using the following protocol 98° C., for 2 min, then 12 cycles of [98° C., for 10 s, 61° C., for 20 s, and 72° C. for 30 s], followed by a final 72° C. extension for 2 min. PCR products were evaluated analytically by electrophoresis in a 1.5% agarose gel. After PCR2, up to 240 samples with different barcode combinations were combined and purified by gel extraction using the QIAquick Gel Extraction Kit (QIAGEN). DNA concentration was quantified using the QUBIT® ssDNA HS Assay Kit (Thermo Fisher Scientific) to make up a 4 nM library. The library concentration was further verified by qPCR (KAPA Library Quantification Kit-Illumina, KAPA Biosystems) and sequenced using an Illumina MiSeq with 210- to 280-bp single-end reads.

Analysis of H TS Data for DNA Sequencing and Targeted Amplicon Sequencing

Sequencing reads were demultiplexed using MiSeq Reporter (Illumina). Batch analysis with CRISPResso2[90] was used for targeted amplicon and DNA sequencing analysis. A 10-bp window was used to quantify indels centered around the middle of the dsDNA spacing. To set the cleavage offset, a hypothetical 15- or 16-bp spacing region has a cleavage offset of ~8. Otherwise, the default parameters were used for analysis. The output file "Reference.NUCLEOTIDE_PERCENTAGE_SUMMARY.txt" was imported into Microsoft Excel for quantification of editing frequencies. Reads containing indels within the 10-bp window are excluded for calculation of editing frequencies. The output file "CRISPRessoBatch_quantification_of_editing_frequency.txt" was imported into Microsoft Excel for quantification of indel frequencies. Indel frequencies were computed by dividing the sum of Insertions and Deletions over the total number of aligned reads.

Bulk ATAC-Seq for Whole Mitochondrial Genome Sequencing

ATAC-seq was performed as previously described[67]. In brief, 5,000-10.000 cells were trypsinzed, washed with PBS, pelleted by centrifugation and lysed in 50 μL of lysis buffer (0.1% Igepal CA-360 (v/v %), 10 mM Tris-HCl, 10 mM NaCl and 3 mM MgCl2 in nuclease-free water). Lysates were incubated on ice for 3 minutes, pelleted at 500 rcf for 10 minutes at 4° C., and tagmented with 2.5 μL of Tn5 transposase (Illumina #15027865) in a total volume of 10 μL containing 1×TD buffer (Illumina #15027866), 0.1% NP-40 (Sigma), and 0.3×PBS. Samples were incubated at 37° C., for 30 minutes on a thermomixer at 300 rpm. DNA was purified using the MinElute PCR Kit (Qiagen) and eluted in 10 μL elution buffer. All 10 μL of the eluate was amplified using indexed primers (1.25 μM each) listed in the Supplementary Sequence section of Example land NEBNext High-Fidelity 2X PCR Master Mix (New England Biolabs) in a total volume of 50 μL using the following protocol 72° C., for 5 min, 98° C., for 30 s, then 5 cycles of [98° C., for 10 s. 63° C., for 30 s, and 72° C., for 60 s], followed by a final 72° C. extension for 1 min. After the initial 5 cycles of pre-amplification, 5 p L of partially amplified library was used as input DNA in a total volume of 15 μL for quantitative PCR using SYBR® Green to determine the number of additional cycles needed to reach 1/3 of the maximum fluorescence intensity. Typically, 3-8 cycles were conducted on the remaining 45 p L of partially amplified library. The final library was purified using a MinElute PCR kit (Qiagen) and quantified using a QUBIT® dsDNA HS Assay kit (Invitrogen) and a High Sensitivity DNA chip run on a Bioanalyzer 2100 system (Agilent). All libraries were sequenced using Nextseq High Output Cartridge kits on an Illumina Nextseq 500 sequencer. Libraries were sequenced using paired-end 2×75 cycles and demultiplexed using the bcl2fastq program.

Genome Sequencing and SNP Identification in Mitochondria

SNP identification in mitochondria was performed similarly to in bacteria, with the following modifications. Genome mapping was performed with BWA (v0.7.17) using NC_012920 genome as a reference. Duplicates were marked using Picard tools (v2.20.7). Pileup data from alignments were generated with SAMtools (v1.9) and variant calling was performed with VarScan2 (v2.4.3). Variants that were present at a frequency greater than 0.1% and a p-value less than 0.05 (Fisher's Exact Test) were called as high-confidence SNPs independently in each biological replicate. Only reads with Q>30 at a given position were taken into account when calling SNPs at that particular position.

Calculation of Average Off-Target C•G-to-T•A Editing Frequency

To calculate the mitochondrial genome-wide average off-target editing frequency for each DdCBE in FIG. 27B, REDItools was used (v1.2.1) (Diroma et al., Brief Bioinform. 20. 436-447 (2019)). All nucleotides except cytidines and guanosines were removed and the number of reads covering each C•G base pair with a PHRED quality score greater than 30 (Q >30) was calculated. The on-target C•G base pairs (depending on the DdCBE used in each treatment) were excluded in order to only consider off-target effects. C•G-to-T•A SNVs present at high frequencies (>50%) in both treated and untreated samples (that therefore did not arise from DdCBE treatment) were also excluded. The average off-target editing frequency was then calculated independently for each biological replicate of each treatment condition as: (number of reads in which a C•G base pair was called as a T•A base pair, summed over all non-target C•G base pairs)+(total number of reads that covered each non-target C•G base pair). Sequence logos in FIG. 27D depicting the local sequence context of all off-target SNVs were generated as described previously[91]. For FIGS. 39A-39E, the average frequency of each SNV was calculated by taking the average of three frequencies from the biological triplicates.

Effect Prediction of the C•G-to-T•A Off-Target SNVs Identified by ATAC-Seq

SIFT (sift.bii.a-star.edu.sg) was used to predict the outcome of nonsynonymous mutations on protein function. High- and low-confidence calls were made using standard SIFT parameters with GRCh37.74 database as the reference genome.

Data Availability

High-throughput sequencing and whole-mitochondria sequencing data is deposited in the NCBI Seqeunce Read Archive (PRJNA603010). Amino acids sequences of all base editors in this study are provided in the Supplementary Sequences section of Example 1.

REFERENCES FOR EXAMPLE 1

1 Komor, A. C., Badran, A. H. & Liu, D. R. CRISPR-Based Technologies for the Manipulation of Eukaryotic Genomes. *Cell* 169, 559, doi:10.1016/j.cell.2017.04.005 (2017).

2 Rees, H. A. & Liu, D. R. Base editing: precision chemistry on the genome and transcriptome of living cells. *Nat Rev Genet* 19, 770-788, doi:10.1038/s41576-018-0059-1 (2018).

3 Iyer, L. M., Zhang, D., Rogozin, I. B. & Aravind, L. Evolution of the deaminase fold and multiple origins of eukaryotic editing and mutagenic nucleic acid deaminases from bacterial toxin systems. *Nucleic acids research* 39. 9473-9497, doi:10.1093/nar/gkr691 (2011).

4 Vafai, S. B. & Mootha, V. K. Mitochondrial disorders as windows into an ancient organelle. *Nature* 491, 374-383, doi:10.1038/nature 11707 (2012).

5 Gopal, R. K, et al. Widespread Chromosomal Losses and Mitochondrial DNA Alterations as Genetic Drivers in Hilrthle Cell Carcinoma. *Cancer Cell* 34, 242-255.e245, doi:doi.org/10.1016/j.ccell.2018.06.013 (2018).

6 Schon, E. A. & Przedborski, S. Mitochondria: the next (neurode)generation. *Neuron* 70, 1033-1053. doi: 10.1016/j.neuron.2011.06.003 (2011).

7 Ryzhkova, A. I, et al. Mitochondrial diseases caused by mtDNA mutations: a mini-review. *Ther Clin Risk Manag* 14. 1933-1942, doi:10.2147/TCRM.S154863 (2018).

8 Craven, L., Alston, C. L., Taylor, R. W. & Turnbull, D. M. Recent Advances in Mitochondrial Disease. *Annual Review of Genomics and Human Genetics* 18, 257-275, doi:10.1146/annurev-genom-091416-035426 (2017).

9 Gammage, P. A., Moraes, C. T. & Minczuk, M. Mitochondrial Genome Engineering: The Revolution May Not Be CRISPR-Ized. *Trends Genet* 34, 101-110, doi:10.1016/j.tig.2017.11.001 (2018).

10 Youssoufian, H. & Pyeritz, R. E. Mechanisms and consequences of somatic mosaicism in humans. *Nat Rev Genet* 3, 748-758. doi:10.1038/nrg906 (2002).

11 Bacman, S. R., Williams, S. L., Pinto, M., Peralta, S. & Moraes, C. T. Specific elimination of mutant mitochondrial genomes in patient-derived cells by mitoTALENs. *Nat Med* 19, 1111-1113, doi:10.1038/nm.3261 (2013).

12 Hashimoto, M, et al. MitoTALEN: A General Approach to Reduce Mutant mtDNA Loads and Restore Oxidative Phosphorylation Function in Mitochondrial Diseases. *Mol Ther* 23, 1592-1599, doi:10.1038/mt.2015.126 (2015).

13 Bacman, S. R, et al. MitoTALEN reduces mutant mtDNA load and restores tRNA(Ala) levels in a mouse model of heteroplasmic mtDNA mutation. *Nat Med* 24, 1696-1700, doi:10.1038/s41591-018-0166-8 (2018).

14 Reddy, P, et al. Selective Elimination of Mitochondrial Mutations in the Germline by Genome Editing. *Cell* 161, 459-469, doi:doi.org/10.1016/j.cell.2015.03.051 (2015).

15 Yang, Y, et al. Targeted elimination of mutant mitochondrial DNA in MELAS-iPSCs by mitoTALENs. *Protein & cell* 9, 283-297, doi:10.1007/s13238-017-0499-y (2018).

16 Pereira, C. V, et al. mitoTev-TALE: a monomeric DNA editing enzyme to reduce mutant mitochondrial DNA levels. *EMBO Mol Med* 10, doi:10.15252/emmm.201708084 (2018).

17 Kazama, T, et al. Curing cytoplasmic male sterility via TALEN-mediated mitochondrial genome editing. *Nat Plants* 5, 722-730, doi:10.1038/s41477-019-0459-z (2019).

18 Gammage, P. A., Rorbach, J., Vincent, A. I., Rebar, E. J. & Minczuk. M. Mitochondrially targeted ZFNs for selective degradation of pathogenic mitochondrial genomes bearing large-scale deletions or point mutations. *EMBO Mol Med* 6, 458-466. doi:10.1002/emmm.201303672 (2014).

19 Gammage, P. A, et al. Near-complete elimination of mutant mtDNA by iterative or dynamic dose-controlled treatment with mtZFNs. *Nucleic Acids Res* 44, 7804-7816, doi:10.1093/nar/gkw676 (2016).

20 Gammage, P. A, et al. Genome editing in mitochondria corrects a pathogenic mtDNA mutation in vivo. *Nat Med* 24, 1691-1695. doi:10.1038/s41591-018-0165-9 (2018).

21 Nissanka, N., Bacman, S. R., Plastini, M. J. & Moraes, C. T. The mitochondrial DNA polymerase gamma degrades linear DNA fragments precluding the formation of deletions. *Nat Commun* 9, 2491, doi:10.1038/s41467-018-04895-1 (2018).

22 Moretton, A, et al. Selective mitochondrial DNA degradation following double-strand breaks. *PLoS One* 12, e0176795, doi:10.1371/joumal.pone.0176795 (2017).

23 Peeva. V, et al. Linear mitochondrial DNA is rapidly degraded by components of the replication machinery. *Nat Commun* 9. 1727, doi:10.1038/s41467-018-04131-w (2018).

24 Carelli, V., Giordano, C. & d'Amati, G. Pathogenic expression of homoplasmic mtDNA mutations needs a complex nuclear& #x2013; mitochondrial interaction. *Trends in Genetics* 19, 257-262, doi:10.1016/S0168-9525(03)00072-6 (2003).

25 Krishnan. K. J, et al. What causes mitochondrial DNA deletions in human cells? *Nature Genetics* 40, 275-279. doi:10.1038/ng.f.94 (2008).

26 Wallace. D. C. & Chalkia. D. Mitochondrial DNA Genetics and the Heteroplasmy Conundrum in Evolution and Disease. *Cold Spring Harbor Perspectives in Biology* 5, doi:10. 1101/cshperspect.a021220 (2013).

27 Coulthurst, S. The Type VI secretion system: a versatile bacterial weapon. *Microbiology* (Reading, England) 165, 503-515, doi:10.1099/mic.0.000789 (2019).

28 Hood, R. D, et al. A type VI secretion system of *Pseudomonas aeruginosa* targets a toxin to bacteria. *Cell host & microbe* 7, 25-37 (2010).

29 Chen. J. & MacCarthy, T. The preferred nucleotide contexts of the AID/APOBEC cytidine deaminases have differential effects when mutating retrotransposon and virus sequences compared to host genes. *PLoS Comput Biol* 13, e1005471, doi:10.1371/journal.pcbi.1005471 (2017).

30 Richardson, S. R., Narvaiza, I., Planegger. R. A., Weitzman, M. D. & Moran, J. V. APOBEC3A deaminates transiently exposed single-strand DNA during LINE-1 retrotransposition. *Elife* 3, e02008, doi:10.7554/eLife.02008 (2014).

31 Matthews, M. M, et al. Structures of human ADAR2 bound to dsRNA reveal base-flipping mechanism and basis for site selectivity. *Nature structural & molecular biology* 23, 426-433, doi:10.1038/nsmb.3203 (2016).

32 Krokan, H. E. & BjOrAs, M. Base Excision Repair. *Cold Spring Harbor Perspectives in Biology* 5, doi:10.1101/cshperspect.a012583 (2013).

33 Bhagwat, A. S, et al. Strand-biased cytosine deamination at the replication fork causes cytosine to thymine mutations in <em>*Escherichia coli*</em>. *Proceedings of the National Academy of Sciences* 113, 2176-2181, doi:10.1073/pnas.1522325113 (2016).

34 Komor, A. C., Kim, Y. B., Packer, M. S., Zuris, J. A. & Liu, D. R. Programmable editing of a target base in genomic DNA without double-stranded DNA cleavage. *Nature* 533, 420. doi:10.1038/nature17946 nature.com/articles/nature17946#supplementary-information (2016).

35 Gaudelli, N. M, et al. Programmable base editing of A•T to G•C in genomic DNA without DNA cleavage. *Nature* 551. 464, doi:10.1038/nature24644 nature.com/articles/nature24644#supplementary-information (2017).

36 Klug, A. The Discovery of Zinc Fingers and Their Applications in Gene Regulation and Genome Manipulation. *Annual Review of Biochemistry* 79, 213-231, doi:10.1146/annurev-biochem-010909-095056 (2010).

37 Joung, J. K. & Sander. J. D. TALENs: a widely applicable technology for targeted genome editing. *Nat Rev Mol Cell Biol* 14, 49-55, doi:10.1038/nrm3486 (2013).

38 Urnov. F. D., Rebar, E. J., Holmes, M. C., Zhang, H. S. & Gregory, P. D. Genome editing with engineered zinc finger nucleases. *Nat Rev Genet* 11, 636-646, doi:10.1038/nrg2842 (2010).

39 Jinek, M, et al. A programmable dual-RNA-guided DNA endonuclease in adaptive bacterial immunity. *Science* 337, 816-821, doi:10.1126/science.1225829 (2012).

40 Qi, L. S, et al. Repurposing CRISPR as an RNA-guided platform for sequence-specific control of gene expression. *Cell* 152, 1173-1183. doi:10.1016/j.cell.2013.02.022 (2013).

41 Kleinstiver, B. P, et al. Broadening the targeting range of *Staphylococcus aureus* CRISPR-Cas9 by modifying PAM recognition. *Nat Biotechnol* 33, 1293-1298, doi:10.1038/nbt.3404 (2015).

42 Nishimasu, H, et al. Crystal Structure of *Staphylococcus aureus* Cas9. *Cell* 162, 1113-1126, doi:10.1016/j.cell.2015.08.007 (2015).

43 Anzalone, A. V, et al. Search-and-replace genome editing without double-strand breaks or donor DNA. *Nature*, doi:10.1038/s41586-019-1711-4 (2019).

44 Nishida, K, et al. Targeted nucleotide editing using hybrid prokaryotic and vertebrate adaptive immune systems. *Science* 353, aaf8729, doi:10.1126/science.aaf8729 (2016).

45 Moscou, M. J. & Bogdanove, A. J. A simple cipher governs DNA recognition by TAL effectors. *Science* 326, 1501. doi:10.1126/science.1178817 (2009).

46 Boch, J, et al. Breaking the code of DNA binding specificity of TAL-type III effectors. *Science* 326, 1509-1512, doi:10.1 126/science. 1178811 (2009).

47 Miller, J. C, et al. A TALE nuclease architecture for efficient genome editing. *Nat Biotechnol* 29. 143-148, doi:10.1038/nbt.1755 (2011).

48 Reyon, D, et al. FLASH assembly of TALENs for high-throughput genome editing. *Nature Biotechnology* 30, 460-465, doi:10.1038/nbt.2170 (2012).
49 Zhang, F, et al. Efficient construction of sequence-specific TAL effectors for modulating mammalian transcription. *Nat Biotechnol* 29, 149-153, doi:10.1038/nbt.1775 (2011).
50 Yang, L, et al. Engineering and optimising deaminase fusions for genome editing. *Nature Communications* 7, 13330, doi:10.1038/ncomms13330 (2016).
51 Reyon, D, et al. Engineering customized TALE nucleases (TALENs) and TALE transcription factors by fast ligation-based automatable solid-phase high-throughput (FLASH) assembly. *Curr Protoc Mol Biol Chapter* 12, Unit 12 16, doi:10.1002/0471142727.mb1216s103 (2013).
52 Guilinger, J. P, et al. Broad specificity profiling of TALENs results in engineered nucleases with improved DNA-cleavage specificity. *Nature Methods* 11, 429435, doi:10.1038/nmeth.2845 (2014).
53 Komor, A. C, et al. Improved base excision repair inhibition and bacteriophage Mu Gam protein yields C:G-to-T:A base editors with higher efficiency and product purity. *Science Advances* 3, eaao4774, doi:10.1126/sciadv.aao4774 (2017).
54 Koblan, L. W, et al. Improving cytidine and adenine base editors by expression optimization and ancestral reconstruction. *Nature Biotechnology* 36, 843, doi:10.1038/nbt.4172 nature.com/articles/nbt.4172 #supplementary-information (2018).
55 Lamb, B. M., Mercer, A. C. & Barbas, C. F., III. Directed evolution of the TALE N-terminal domain for recognition of all 5' bases. *Nucleic Acids Research* 41. 9779-9785. doi:10.1093/nar/gkt754 (2013).
56 Nilsen, H, et al. Nuclear and mitochondrial uracil-DNA glycosylases are generated by alternative splicing and transcription from different positions in the UNG gene. *Nucleic Acids Res* 25, 750-755, doi:10.1093/nar/25.4.750 (1997).
57 Bharati. S., Krokan. H. E., Kristiansen, L., Otterlei, M. & Slupphaug, G. Human mitochondrial uracil-DNA glycosylase preform (UNG1) is processed to two forms one of which is resistant to inhibition by AP sites. *Nucleic Acids Research* 26, 4953-4959, doi:10.1093/nar/26.21.4953 (1998).
58 Lauritzen, K. H, et al. Mitochondrial DNA toxicity in forebrain neurons causes apoptosis, neurodegeneration, and impaired behavior. *Mol Cell Biol* 30, 1357-1367, doi:10.1 128/MCB.0 1149-09 (2010).
59 Stuart. J. A, et al. DNA base excision repair activities and pathway function in mitochondrial and cellular lysates from cells lacking mitochondrial DNA. *Nucleic acids research* 32, 2181-2192, doi:10.1093/nar/gkh533 (2004).
60 Alexeyev, M. F, et al. Selective elimination of mutant mitochondrial genomes as therapeutic strategy for the treatment of NARP and MILS syndromes. *Gene Therapy* 15, 516-523, doi:10.1038/gt.2008.11 (2008).
61 Minczuk, M., Papworth, M. A., Miller, J. C., Murphy, M. P. & Klug, A. Development of a single-chain, quasi-dimeric zinc-finger nuclease for the selective degradation of mutated human mitochondrial DNA. *Nucleic Acids Res* 36, 3926-3938, doi:10.1093/nar/gkn313 (2008).
62 Andreazza, S, et al. Mitochondrially-targeted APOBEC1 is a potent mtDNA mutator affecting mitochondrial function and organismal fitness in *Drosophila. Nat Commun* 10. 3280. doi:10.1038/s41467-019-10857-y (2019).
63 Shokolenko, I., Venediktova, N., Bochkareva, A., Wilson, G. L. & Alexeyev. M. F. Oxidative stress induces degradation of mitochondrial DNA. *Nucleic Acids Res* 37, 2539-2548, doi:10.1093/nar/gkp100 (2009).
64 Liu, P. & Demple, B. DNA repair in mammalian mitochondria: Much more than we thought? *Environ Mol Mutagen* 51, 417-426. doi:10.1002/em.20576 (2010).
65 Gopal, R. K, et al. Early loss of mitochondrial complex I and rewiring of glutathione metabolism in renal oncocytoma. *Proc Natl Acad Sci USA* 115, E6283-E6290, doi:10.1073/pnas.1711888115 (2018).
66 Zhang, X. H., Tee, L. Y., Wang, X. G., Huang. Q. S. & Yang, S. H. Off-target Effects in CRISPR/Cas9-mediated Genome Engineering. *Mol Ther Nucleic Acids* 4, e264, doi:10.1038/mtna.2015.37 (2015).
67 Ludwig, L. S, et al. Lineage Tracing in Humans Enabled by Mitochondrial Mutations and Single-Cell Genomics. *Cell* 176, 1325-1339 e1322, doi:10.1016/j.cell.2019.01.022 (2019).
68 Corces, M. R, et al. An improved ATAC-seq protocol reduces background and enables interrogation of frozen tissues. *Nat Methods* 14, 959-962, doi:10.1038/nmeth.4396 (2017).
69 Xu, J, et al. Single-cell lineage tracing by endogenous mutations enriched in transposase accessible mitochondrial DNA. *Elife* 8, doi:10.7554/eLife.45105 (2019).
70 Cuculis, L., Abil. Z., Zhao, H. & Schroeder, C. M. Direct observation of TALE protein dynamics reveals a two-state search mechanism. *Nature Communications* 6, 7277, doi:10.1038/ncomms8277 (2015).
71 Rinaldi, F. C., Doyle, L. A., Stoddard, B. L. & Bogdanove. A. J. The effect of increasing numbers of repeats on TAL effector DNA binding specificity. *Nucleic Acids Res* 45, 6960-6970, doi:10.1093/nar/gkx342 (2017).
72 Meckler, J. F, et al. Quantitative analysis of TALE-DNA interactions suggests polarity effects. *Nucleic Acids Res* 41, 4118-4128, doi:10.1093/nar/gkt085 (2013).
73 Rogers, J. M, et al. Context influences on TALE-DNA binding revealed by quantitative profiling. *Nat Commun* 6, 7440, doi:10.1038/ncomms8440 (2015).
74 Thuronyi, B. W, et al. Continuous evolution of base editors with expanded target compatibility and improved activity. *Nat Biotechnol* 37, 1070-1079. doi:10.1038/s41587-019-0193-0 (2019).
75 Naeem, M. M. & Sondheimer, N. in *Mitochondria in Health and in Sickness* (eds Andrea Urbani & Mohan Babu) 257-267 (Springer Singapore, 2019).
76 Filograna. R, et al. Modulation of mtDNA copy number ameliorates the pathological consequences of a heteroplasmic mtDNA mutation in the mouse. *Sci Adv* 5, eaav9824, doi:10.1126/sciadv.aav9824 (2019).
77 Heberle, H., Meirelles, G. V., da Silva. F. R., Telles, G. P. & Minghim, R. InteractiVenn: a web-based tool for the analysis of sets through Venn diagrams. *BMC Bioinformatics* 16, 169, doi:10.1186/s12859-015-0611-3 (2015).
78 Shi, K, et al. Structural basis for targeted DNA cytosine deamination and mutagenesis by APOBEC3A and APOBEC3B. *Nat Struct Mol Biol* 24, 131-139, doi:10.1038/nsmb.3344 (2017).
79 Rietsch, A., Vallet-Gely, L., Dove, S. L. & Mekalanos, J. J. ExsE, a secreted regulator of type III secretion genes in *Pseudomonas aeruginosa. Proc Natl Acad Sci USA* 102, 8006-8011, doi:10.1073/pnas.0503005102 (2005).
80 Fazli, M., Harrison, J. J., Gambino, M., Givskov, M. & Tolker-Nielsen, T. In-Frame and Unmarked Gene Deletions in *Burkholderia cenocepacia* via an Allelic Exchange System Compatible with Gateway Technology. *Appl Environ Microbiol* 81. 3623-3630. doi:10.1 128/AEM.03909-14 (2015).
81 Choi, K. H., DeShazer, D. & Schweizer, H. P. mini-Tn7 insertion in bacteria with multiple gimS-linked attTn7 sites: example *Burkholderia mallei* ATCC 23344. *Nat Protoc* 1, 162-169, doi:10.1038/nprot.2006.25 (2006).
82 Rees, H. A., Wilson, C., Doman, J. L. & Liu, D. R. Analysis and minimization of cellular RNA editing by DNA adenine base editors. *Sci Adv* 5, eaax5717, doi:10.1 126/sciadv.aax5717 (2019).
83 Otwinowski, Z. & Minor. W. Processing of X-ray diffraction data collected in oscillation mode. *Methods Enzymol* 276, 307-326 (1997).
84 Adams, P. D, et al. PHENIX: a comprehensive Python-based system for macromolecular structure solution. *Acta Crystallogr D Biol Crystallogr* 66. 213-221, doi:10.1107/S0907444909052925 (2010).
85 Emsley, P. & Cowtan, K. Coot: model-building tools for molecular graphics. *Acta Crystallogr D Biol Crystallogr* 60, 2126-2132, doi:10.1107/S0907444904019158 (2004).
86 Painter, J. & Merritt, E. A. Optimal description of a protein structure in terms of multiple groups undergoing TLS motion. *Acta Crystallogr D Biol Crystallogr* 62, 439-450, doi:10.1107/S0907444906005270 (2006).
87 Chen, V. B, et al. MolProbity: all-atom structure validation for macromolecular crystallography. *Acta Crystallogr D Biol Crystallogr* 66, 12-21, doi:10.1107/S0907444909042073 (2010).
88 Li, H. & Durbin, R. Fast and accurate short read alignment with Burrows-Wheeler transform. *Bioinformatics* 25, 1754-1760, doi:10.1093/bioinformatics/btp324 (2009).
89 Koboldt, D. C, et al. VarScan 2: somatic mutation and copy number alteration discovery in cancer by exome sequencing. *Genome Res* 22, 568-576, doi:10.1101/gr.129684.111 (2012).
90 Clement, K, et al. CRISPResso2 provides accurate and rapid genome editing sequence analysis. *Nat Biotechnol* 37, 224-226, doi:10.1038/s41587-019-0032-3 (2019).
91 Doman, J. L. R., A., Newby, G.A. & Liu, D.R. Evaluation and minimization of Cas9-independent off-target DNA editing by cytosine base editors *Nature Biotechnology* in press (2019).

Supplementary Discussion

Toxicity of Intact $DddA_{tox}$ Fused to DNA-Binding Proteins

To characterize $DddA_{tox}$ activity in human cells, we transfected HEK293T cells with plasmids encoding $DddA_{tox}$ fused to catalytically inactive *S. pyogenes* Cas9 (dSpCas9)[1,2] or SpCas9(D10A) nickase". (FIG. 40A). We observed a 2-10 fold lower viability in cells transfected with $DddA_{tox}$-Cas9 fusions compared to BE2 (a non-nicking cytosine base editor with two copies of UGI protein)[4] and BE4max (an optimized current-generation cytosine base editor)[5,6] (FIG. 40B). While BE2 and BE4max exhibited between 5-17% and 17-55% target C•G-to-T•A conversion efficiency, respectively, (FIG. 40C), the widespread toxicity induced by DddAto-Cas9 precluded PCR amplification of target DNA sites from the few surviving cells for high-throughput sequencing.

Editing Efficiencies of $DddA_{tox}$ Splits G1322, A1343, N1357, G1371 and N1387

Splits A1343, G1371, and N1387 resulted in <0.1% conversion of C•G-to-T•A at TC target bases across all tested spacing lengths (FIGS. 32A-32H). G1322 and N1357 gave a maximum of 8.3% and 22% C•G-to-T•A conversion, respectively, within a 44-bp spacing regions (FIG. 32G), but editing efficiencies at other lengths of spacing regions were generally below 5.6% (FIGS. 32A-32H).

Indel Frequencies Associated with Split-$DddA_{tox}$-Cas9 Fusions

The level of indels associated with splits that afforded the highest editing efficiency (G1333 and G1397) were higher than those of canonical cytosine base editors[6], up to 46% for some split fusion combinations (FIG. 43). We speculate that strand nicking by SaKKH-Cas9(D10A), combined with uracil excision on either strand[7] can induce double-strand breaks that induce indel formation through end-joining processes[8,9].

Preliminary Observations Governing Editing Efficiency and Selectivity of Split-$DddA_{tox}$ for Subsequent DdCBE Editing Cytidines in TCC contexts appeared to be favorable substrates for deamination for split-$DddA_{tox}$. TCC target bases are generally deaminated at varying efficiencies depending on their positions within the dsDNA spacing region (FIGS. 32D-32H). We observed modest C•G-to-T•A conversions between 2.0-8.5% within spacing region lengths of 28-, 33- and 39-bp (FIGS. 32D-32F). Editing efficiencies were elevated to 48±1.7% and 26±0.65% at 44- and 60-bp spacing lengths, respectively (FIGS. 32G-32H). In addition to TCC, split-$DddA_{tox}$ also mediated deamination of cytidines in TCA (FIGS. 30A-C, and FIGS. 32E-G) and TCT (FIGS. 32B-32C, and FIG. 32G) contexts.

The selectivity of editing also depended on the fusion orientation. For 17-bp spacing length, we observed preferential deamination of target TCs that were closer to the protospacer of the Cas9 monomer fused to $DddA_{tox}$-C. (FIG. 32D). For longer spacing region lengths (44- and 60-bp), target bases closer to the protospacer of the Cas9 monomer fused to $DddA_{tox}$-N were preferentially deaminated (FIGS. 32G-32H).

In light of the above results, we designed subsequent mitoTALE binding sites to flank a spacing region approximately 15-18 bp long that contains TCC and/or TCA target bases. To assess the substrate selectivity and editing efficiency of mitoTALE-split-$DddA_{tox}$, we also included the two possible orientations for each G1333 and G1397 split.

Efforts to Increase Mitochondrial Localization of MTS-mitoTALLE-Split-$DddA_{tox}$-1xUGI We fused zmLOC100282174, a *Zea mays*-derived MTS previously reported to induce high mitochondrial localization in human lymphoblasts[10], in tandem to SOD2 or COX8A MTS sequence. However, the dual MTS sequence lowered or had no effect on base editing efficiencies (FIG. 44), suggesting that these MTS variants may not be fully compatible with our constructs, or that mitochondrial localization may not be limiting the editing efficiency of these fusions.

Detecting mtDNA Deletions in DdCBE-Treated Human HEK293T Cells

Long-range PCR of the whole mitochondrial genome resulted in a shorter DNA band for ND6-DdCBE-treated cells compared to amplicons obtained from cells treated with ND6-dead-DdCBE (FIG. 36B). The truncated amplicon from positions 2478-10858 of the mitochondrial DNA restored to its full length after day 12 (left panel), while the truncated amplicon from positions 2688-10653 persisted to the end of the experiment (day 18). However, we did not detect any large deletions in HEK293T cells 3 days after treatment with ND6-DdCBE (FIG. 47) which would have manifested as regions in the mtDNA with no sequencing coverage, suggesting that shorter amplicons observed in the DNA gel may arise from PCR artefacts.

Durability of C•G-to-T•A Mitochondrial DNA Conversions in HEK293T Cells

From day 12 to day 18, cells treated with ND6-DdCBE had a 6.2% decrease out of 27-34% total edits at C6 and C7 (FIG. 37A). Missense mutations induced by DdCBEs could have impaired mitochondrial fitness, thereby placing them at a selective disadvantage for mtDNA replication. We also noted that BE4max-mediated editing of $C_5$ and $C_6$, which decreased by 12% out of 57-70% total editing (FIG. 37E).

Three-Day Time Course Expression Studies on DdCBEs

We wondered if DdCBE expression levels could explain the differences in average off-target editing frequencies and SNV numbers among standard DdCBEs that share the same architectures of wild-type NTDs and deaminases, but contain different lengths and sequences of TALE array repeats. We compared expression levels of ND5.1-DdCBE, ND5.2-DdCBE and ATP8-DdCBE over a three-day period and observed no significant differences, suggesting that the steady-state expression of DdCBEs cannot account for the differences in off-target activities (FIGS. 48A-48B and FIG. 53).

Predicted Effects of Off-Target SNVs on mtDNA Sequence and Protein Function

Approximately one-third of the total off-target mutations for each DdCBE resulted in missense mutations, while approximately two-thirds of the off-target mutations were in non-coding regions or led to synonymous mutations in coding regions (FIG. 49A). Among the missense mutations, more than half were predicted to be deleterious to protein function (FIG. 49B). We note that unannotated SNVs in non-coding rRNA and tRNA, which were excluded in SIFT analysis, could also have functional consequences[11]. To validate the SNV-calling pipeline, we selected 1-18 SNVs called for the different DdCBEs for targeted amplicon sequencing and verified all 35 to be bona-fide off-target SNVs (FIG. 49C).

REFERENCES FOR SUPPLEMENTARY DISCUSSION

1 Jinek, M, et al. A programmable dual-RNA-guided DNA endonuclease in adaptive bacterial immunity. *Science* 337, 816-821, doi:10.1126/science.1225829 (2012).

2 Qi, L. S, et al. Repurposing CRISPR as an RNA-guided platform for sequence-specific control of gene expression. *Cell* 152, 1173-1183, doi:10.1016/j.cell.2013.02.022 (2013).

3 Cong, L, et al. Multiplex Genome Engineering Using CRISPR/Cas Systems. *Science* 339, 819-823, doi:10.1126/science.1231143 (2013).

4 Komor, A. C., Kim. Y. B., Packer, M. S., Zuris, J. A. & Liu, D. R. Programmable editing of a target base in genomic DNA without double-stranded DNA cleavage. *Nature* 533, 420. doi:10.1038/nature17946 nature.com/articles/nature17946 #supplementary-information (2016).

5 Komor, A. C, et al. Improved base excision repair inhibition and bacteriophage Mu Gam protein yields C:G-to-T:A base editors with higher efficiency and product purity. *Science Advances* 3, eaao4774, doi:10.1126/sciadv.aao4774 (2017).

6 Koblan, L. W, et al. Improving cytidine and adenine base editors by expression optimization and ancestral reconstruction. *Nature Biotechnology* 36, 843, doi:10.1038/nbt.4172nature.com/articles/nbt.4172 #supplementary-information (2018).

7 Krokan, H. E. & Bjords, M. Base Excision Repair. *Cold Spring Harbor Perspectives in Biology* 5, doi:10.1101/cshperspect.a012583 (2013).

8 Bothmer. A, et al. Characterization of the interplay between DNA repair and CRISPR/Cas9-induced DNA lesions at an endogenous locus. *Nature Communications* 8, 13905, doi:10.1038/ncomms13905 (2017).

9 Harrison, L., Brame, K. L., Geltz, L. E. & Landry, A. M. Closely opposed apurinic/apyrimidinic sites are converted to double strand breaks in *Escherichia coli* even in the absence of exonuclease III, endonuclease IV, nucleotide excision repair and AP lyase cleavage. *DNA Repair* (*Amst*) 5, 324-335, doi:10.1016/j.dnarep.2005.10.009 (2006).

10 Chin, R. M., Panavas, T., Brown, J. M. & Johnson, K. K. Optimized Mitochondrial Targeting of Proteins Encoded by Modified mRNAs Rescues Cells Harboring Mutations in mtATP6. *Cell Rep* 22, 2818-2826, doi:10.1016/j.celrep.2018.02.059 (2018).

11 Ruiz-Pesini, E, et al. An enhanced MITOMAP with a global mtDNA mutational phylogeny. *Nucleic Acids Res* 35, D823-828. doi:10.1093/nar/gkl927 (2007).

12 Lott, M. T, et al. mtDNA Variation and Analysis Using Mitomap and Mitomaster. *Curr Protoc Bioinformatics* 44, 1 23 21-26, doi:10.1002/0471250953.bi0123s44 (2013).

13 Lin. Y, et al. SAPTA: a new design tool for improving TALE nuclease activity. *Nucleic Acids Res* 42, e47, doi:10.1093/nar/gkt1363 (2014).

Tables

TABLE 2

Diffraction data collection and refinement statistics for DddA/DddIA

| | $Ddd_A/DddI_A$ SAD peak[a] |
|---|---|
| PDB accession code | 61308 |
| Data Collection | |
| Space group | $P2_12_12$ |
| Cell dimension | |
| a, b, c (Å) | 126.8, 145.0, 64.2 |
| α, β, γ(°) | 90, 90, 90 |
| Wavelength (Å) | 0.9790 |
| Resolution (Å) | 38.6-2.5 (2.53-2.50)[b] |
| No. unique reflections | 41658 (1339) |
| $R_{merge}$ | 0.12 (1.2) |
| I/σI | 26.7 (2.0) |
| Completeness (%) | |
| Total | 98.9 (96.7) |
| Anomalous | 99.0 |
| Redundancy | 13.0 (12.6) |
| Wilson B-factor ($Å^2$) | 46.2 |
| Refinement | |
| Resolution (Å) | 38.6-2.5 (2.53-2.50) |
| No. reflections | 41655 (2789) |
| Rwork Rfree (%) | 17.2/22.8 (26.3/34.6) |
| No. atoms | 7889 |
| Protein | 7796 |
| Ligand/ion | 4 |
| Water | 89 |
| B-factors ($Å^2$) | |
| Protein | 59.2 |
| Ligand/ion | 72.3 |
| Water | 50.7 |
| rmsd | |
| Bond lengths (Å) | 0.012 |
| Bond angles (°) | 1.091 |

TABLE 2-continued

Diffraction data collection and refinement statistics for DddA/DddIA

| | $Ddd_A/DddI_A$ SAD peak[a] |
|---|---|
| Missing residues | |
| chain A | 1250-1289, 1423-1427 |
| chain B | 71-3 |
| chain C | 1250-1289, 1423-1427 |
| chain D | 72-3 |
| chain E | 1250-1290, 1423-1427 |
| chain F | none |
| chain G | 1250-1290, 1423-1427 |
| chain H | none |

TABLE 3

MitoTALE binding sites for each DdCBE. Sequences start from the 5' nucleotide recognized by the first repeat in the TALE array ($N_1$ position) and end with the nucleotide recognized by the carboxy-terminal truncated 'half' repeat. De novo TALE-binding sequences were designed using the following guidelines[13]: (i) 15-20 bp long, (ii) thymidine at the 3'-end, (iii) large %C within the first 5 nucleotides if possible and (iv) large %T within the last 5 nucleotides if possible. Remaining target sequences were from previously published mitoTALEs (green) or adapted to recognize a different nucleotide at the $N_1$ position (red). See the Supplementary Sequences section below for mitoTALE sequences. Top to bottom the left-mitoTALE sequences correspond to SEQ ID NO: 146-152. Top to bottom the right-mitoTALE sequences correspond to SEQ ID NO: 153-159.

| DdCBE | Left-mito TALE target sequence | Right-mitoTALE target sequence |
|---|---|---|
| ND1 | 5'-CTAGCCTAGCCGTTT-3'<br>De novo | 5'-GAGTTTGATGCTCACCCT-3'<br>De novo |
| ND2 | 5'-CTTAGCATACTCCTCAAT-3'<br>De novo | 5'-AGAACTGCTATTATT-3'<br>De novo |
| ND4 | 5'-GCTAGTAACCACGTTCT-3'<br>De novo | 5'-CCTGTAAGTAGGAGAGT-3'<br>De novo |
| ND5.1 | 5'-AGCATTAGCAGGAAT-3'<br>From Hashimoto. M et al, 2015 | 5'-CTTTGGAGTAGAA-3'<br>Adapted from Hashimoto. M et al., 2015 to recognize C over T at the N, position |
| ND5.2 | 5'-CAAAACCATACCTCT-3'<br>De novo | 5'-GCTAGGCTGCCAATGT-3'<br>From Bacman. S et al, 2013 |
| ND5.3 | 5'-CAGTTCTTCAAATAT-3'<br>De novo | AAGATTAGTATGGT<br>Ds novo |
| ATP8 | 5'-ATTAAACACAAACTAT-3'<br>From Bacman. S et al, 2013 | 5'-ATGGGCTTTGGT-3'<br>De novo |

TABLE 4

P-values from comparison of editing efficiencies from time course experiments in HEK293T cells and U2OS cells.
For a given DdCBE, the P-value for editing efficiencies of target cytidine across two cumulative timepoints is shown. P-values were calculated using the Student's two-tailed paired t-test. Entries are highlighted in red if the P-value indicated a significant difference ($P < 0.05$).

HEK293T cells

| Base editor and cytidine position | Day3 VS Day6 | Day6 VS Day12 | Day12 VS Day18 |
|---|---|---|---|
| ND6-DdCBE, C6 | 0.003248338 | 0.367579396 | 0.015940359 |
| ND6-DdCBE, C7 | 0.002586263 | 0.565703966 | 0.020813553 |
| ND6-DdCBE, C11 | 0.007464037 | 0.3659328 | 0.013874452 |
| ND6-DdCBE, C13 | 0.002564148 | 0.45334421 | 0.014317529 |
| ND5.1-DdCBE, C10 | 0.004716876 | 0.094419717 | 0.047243751 |
| ND5.2-DdCBE, C12 | 0.023166261 | 0.064203104 | 0.058523608 |
| ND5.2-DdCBE, C13 | 0.028990618 | 0.025844251 | 0.052962149 |
| ATP8-DdCBE, C12 | 0.004113271 | 0.048822963 | 0.052625302 |
| ATP8-DdCBE, C13 | 0.011630525 | 0.099114459 | 0.042920243 |
| BE2, C5 | 0.732951948 | 0.035726897 | 0.00268113 |

TABLE 4-continued

P-values from comparison of editing efficiencies from time course experiments in HEK293T cells and U2OS cells.
For a given DdCBE, the P-value for editing efficiencies of target cytidine across two cumulative timepoints is shown. P-values were calculated using the Student's two-tailed paired t-test. Entries are highlighted in red if the P-value indicated a significant difference ($P < 0.05$).

| | | | |
|---|---|---|---|
| BE2, C6 | 0.746509043 | 0.057803697 | 0.005118562 |
| BE4max, CS | 0.630498196 | 0.838864469 | 0.010147598 |
| BE4max, C6 | 0.575297544 | 0.865037977 | 0.008872013 |

U2OS cells

| Base editor and cytidine position | Day3 VS Day6 | Day6 VS Day12 | Day12 VS Day18 |
|---|---|---|---|
| ND6-DdCBE, C6 | 0.000590938 | 0.390452684 | 0.069490317 |
| ND6-DdCBE, C7 | 0.000492063 | 0.464334118 | 0.146219197 |
| ND6-DdCBE, C11 | 0.007736858 | 0.191482179 | 0.042318087 |
| ND6-DdCBE, C13 | 0.003832983 | 0.194483146 | 0.074581243 |
| ND5.1-DdCBE, C10 | 0.003808745 | 0.328396021 | 0.189480814 |
| ND5.2-DdCBE, C12 | 0.13305717 | 0.937487147 | 0.484054682 |
| ND5.2-DdCBE, C13 | 0.190940372 | 0.54498276 | 0.48011839 |
| ATP8-DdCBE, C12 | 0.107997405 | 0.427059997 | 0.041850528 |
| ATP8-DdCBE, C13 | 0.172196805 | 0.381406262 | 0.030673134 |
| CCR5-DdCBE, C9 | 0.29867603 | 0.934543801 | 0.6557219 |
| CCR5-DdCBE, C10 | 0.299897207 | 0.904216914 | 0.56590558 |
| CCR5-DdCBE, C16 | 0.273229353 | 0.769787171 | 0.967771498 |

TABLE 5

Unique off-target SNVs mediated by DdCBEs.

| SN position | Reference nucleotide | Altered nucleotide | Average % frequency |
|---|---|---|---|
| *64* | *C* | *T* | *1.34%* |
| *94* | *G* | *A* | *0.35%* |
| *120* | *C* | *T* | *0.47%* |
| *147* | *C* | *T* | *0.39%* |
| *150* | *C* | *T* | *0.86%* |
| *162* | *C* | *T* | *0.21%* |
| *229* | *G* | *A* | *0.16%* |
| *320* | *C* | *T* | *0.09%* |
| *431* | *C* | *T* | *0.07%* |
| *461* | *C* | *T* | *0.40%* |
| *486* | *C* | *T* | *0.18%* |
| *505* | *C* | *T* | *1.74%* |
| *594* | *C* | *T* | *0.51%* |
| *597* | *C* | *T* | *0.55%* |
| *622* | *G* | *A* | *0.69%* |
| *635* | *C* | *T* | *0.97%* |
| *660* | *C* | *T* | *5.79%* |
| *705* | *C* | *T* | *1.13%* |
| *712* | *C* | *T* | *0.29%* |
| *734* | *C* | *T* | *0.07%* |
| *740* | *G* | *A* | *1.34%* |
| *759* | *C* | *T* | *0.36%* |
| *822* | *G* | *A* | *0.17%* |
| *880* | *C* | *T* | *0.91%* |
| *904* | *C* | *T* | *0.55%* |
| *909* | *G* | *A* | *0.34%* |
| *951* | *G* | *A* | *0.08%* |
| *954* | *C* | *T* | *0.27%* |
| *962* | *C* | *T* | *0.08%* |
| *1007* | *G* | *A* | *0.07%* |
| *1018* | *G* | *A* | *0.10%* |
| *1074* | *G* | *A* | *0.59%* |
| *1133* | *C* | *T* | *0.08%* |
| *1170* | *G* | *A* | *0.82%* |
| *1190* | *C* | *T* | *0.44%* |
| *1216* | *C* | *T* | *0.24%* |
| *1217* | *G* | *A* | *0.10%* |
| *1227* | *G* | *A* | *1.69%* |
| *1230* | *C* | *T* | *0.16%* |
| *1236* | *C* | *T* | *0.27%* |
| *1250* | *C* | *T* | *0.41%* |
| *1271* | *C* | *T* | *0.43%* |

TABLE 5-continued

Unique off-target SNVs mediated by DdCBEs.

| SN position | Reference nucleotide | Altered nucleotide | Average % frequency |
|---|---|---|---|
| *1282* | *G* | *A* | *0.48%* |
| *1290* | *C* | *T* | *0.07%* |
| *1320* | *G* | *A* | *0.37%* |
| *1330* | *C* | *T* | *0.47%* |
| *1345* | *G* | *A* | *0.08%* |
| *1411* | *G* | *A* | *0.09%* |
| *1412* | *G* | *A* | *0.38%* |
| *1414* | *C* | *T* | *0.55%* |
| *1415* | *G* | *A* | *0.28%* |
| *1422* | *G* | *A* | *0.35%* |
| *1469* | *G* | *A* | *0.21%* |
| *1491* | *C* | *T* | *1.61%* |
| *1497* | *C* | *T* | *0.26%* |
| *1500* | *C* | *T* | *0.37%* |
| *1511* | *C* | *T* | *0.07%* |
| *1516* | *G* | *A* | *0.49%* |
| *1554* | *G* | *A* | *0.11%* |
| *1561* | *C* | *T* | *0.08%* |
| *1595* | *G* | *A* | *4.53%* |
| *1660* | *G* | *A* | *0.11%* |
| *1709* | *G* | *A* | *0.49%* |
| *1750* | *G* | *A* | *0.35%* |
| *1831* | *G* | *A* | *1.35%* |
| *1913* | *G* | *A* | *2.41%* |
| *1951* | *C* | *T* | *0.48%* |
| *1970* | *G* | *A* | *0.64%* |
| *1990* | *G* | *A* | *1.59%* |
| *2024* | *C* | *T* | *2.23%* |
| *2070* | *C* | *T* | *0.08%* |
| *2076* | *C* | *T* | *0.11%* |
| *2100* | *C* | *T* | *1.99%* |
| *2121* | *G* | *A* | *0.56%* |
| *2257* | *C* | *T* | *0.35%* |
| *2269* | *G* | *A* | *2.45%* |
| *2328* | *C* | *T* | *0.10%* |
| *2331* | *C* | *T* | *0.87%* |
| *2347* | *C* | *T* | *1.64%* |
| *2349* | *G* | *A* | *0.07%* |
| *2366* | *G* | *A* | *0.42%* |
| *2423* | *C* | *T* | *0.51%* |
| *2511* | *C* | *T* | *0.40%* |
| *2523* | *C* | *T* | *0.50%* |

TABLE 5-continued

Unique off-target SNVs mediated by DdCBEs.

| SN position | Reference nucleotide | Altered nucleotide | Average % frequency |
|---|---|---|---|
| 2553 | G | A | 0.10% |
| 2611 | C | T | 0.16% |
| 2622 | G | A | 0.79% |
| 2643 | G | A | 0.08% |
| 2657 | C | T | 0.07% |
| 2692 | G | A | 0.47% |
| 2716 | G | A | 1.07% |
| 2719 | G | A | 0.07% |
| 2724 | G | A | 0.09% |
| 2779 | C | T | 0.75% |
| 2819 | G | A | 0.66% |
| 2824 | C | T | 0.47% |
| 2826 | G | A | 0.32% |
| 2842 | C | T | 0.14% |
| 2844 | G | A | 0.09% |
| 2865 | C | T | 0.10% |
| 2872 | C | T | 0.07% |
| 2899 | C | T | 1.09% |
| 2909 | G | A | 0.78% |
| 2917 | G | A | 0.50% |
| 2934 | G | A | 0.36% |
| 2948 | C | T | 0.24% |
| 2961 | C | T | 0.61% |
| 2983 | G | A | 0.50% |
| 2988 | C | T | 0.09% |
| 2989 | G | A | 1.08% |
| 2996 | G | A | 1.73% |
| 2999 | C | T | 0.27% |
| 3002 | G | A | 1.10% |
| 3007 | C | T | 2.38% |
| 3010 | G | A | 1.04% |
| 3047 | G | A | 0.31% |
| 3056 | C | T | 0.63% |
| 3063 | G | A | 0.08% |
| 3066 | C | T | 0.19% |
| 3075 | G | A | 0.17% |
| 3080 | G | A | 0.36% |
| 3087 | C | T | 0.97% |
| 3093 | C | T | 0.85% |
| 3119 | C | T | 0.47% |
| 3132 | G | A | 1.40% |
| 3155 | C | T | 0.09% |
| 3168 | C | T | 0.63% |
| 3187 | C | T | 0.09% |
| 3279 | C | T | 0.45% |
| 3324 | C | T | 0.25% |
| 3333 | C | T | 0.37% |
| 3351 | C | T | 0.51% |
| 3453 | C | T | 0.21% |
| 3457 | G | A | 1.53% |
| 3474 | C | T | 0.61% |
| 3503 | C | T | 0.46% |
| 3510 | C | T | 0.40% |
| 3522 | C | T | 1.13% |
| 3531 | G | A | 0.74% |
| 3549 | C | T | 0.57% |
| 3556 | C | T | 0.09% |
| 3573 | C | T | 0.16% |
| 3594 | C | T | 2.49% |
| 3600 | C | T | 0.13% |
| 3612 | C | T | 0.37% |
| 3654 | C | T | 0.37% |
| 3659 | G | A | 0.60% |
| 3662 | C | T | 0.76% |
| 3668 | G | A | 0.08% |
| 3693 | G | A | 0.49% |
| 3696 | C | T | 2.02% |
| 3738 | C | T | 0.20% |
| 3750 | C | T | 0.09% |
| 3804 | C | T | 0.21% |
| 3824 | G | A | 0.07% |
| 3839 | C | T | 0.26% |
| 3842 | G | A | 0.10% |
| 3869 | C | T | 0.26% |
| 3882 | G | A | 0.68% |

TABLE 5-continued

Unique off-target SNVs mediated by DdCBEs.

| SN position | Reference nucleotide | Altered nucleotide | Average % frequency |
|---|---|---|---|
| 3900 | C | T | 0.46% |
| 3901 | G | A | 0.62% |
| 3903 | C | T | 0.08% |
| 3910 | G | A | 0.71% |
| 3920 | C | T | 1.20% |
| 3922 | G | A | 0.17% |
| 3930 | C | T | 0.17% |
| 3945 | C | T | 0.82% |
| 3966 | C | T | 0.63% |
| 3978 | C | T | 0.30% |
| 4032 | C | T | 0.52% |
| 4037 | G | A | 0.22% |
| 4048 | G | A | 1.02% |
| 4086 | C | T | 1.15% |
| 4127 | G | A | 0.08% |
| 4142 | G | A | 0.18% |
| 4153 | G | A | 1.98% |
| 4170 | C | T | 0.24% |
| 4185 | C | T | 0.32% |
| 4273 | C | T | 0.45% |
| 4275 | G | A | 0.18% |
| 4333 | G | A | 0.95% |
| 4345 | C | T | 0.08% |
| 4354 | C | T | 0.85% |
| 4364 | C | T | 0.40% |
| 4374 | C | T | 0.08% |
| 4387 | C | T | 0.24% |
| 4397 | C | T | 1.10% |
| 4410 | C | T | 0.59% |
| 4426 | C | T | 0.37% |
| 4461 | C | T | 0.42% |
| 4476 | C | T | 0.71% |
| 4493 | C | T | 1.40% |
| 4496 | C | T | 0.55% |
| 4526 | C | T | 0.63% |
| 4593 | C | T | 0.34% |
| 4620 | C | T | 0.08% |
| 4624 | C | T | 0.07% |
| 4629 | G | A | 0.09% |
| 4640 | C | T | 0.32% |
| 4652 | C | T | 0.60% |
| 4669 | C | T | 2.96% |
| 4676 | C | T | 6.03% |
| 4714 | G | A | 2.27% |
| 4789 | G | A | 0.41% |
| 4808 | C | T | 0.21% |
| 4814 | C | T | 1.60% |
| 4841 | G | A | 0.49% |
| 4846 | C | T | 4.69% |
| 4860 | C | T | 0.40% |
| 4867 | G | A | 0.43% |
| 4908 | C | T | 0.14% |
| 4912 | C | T | 0.07% |
| 4931 | C | T | 0.10% |
| 4934 | C | T | 0.79% |
| 4951 | C | T | 0.60% |
| 4955 | C | T | 0.17% |
| 4969 | G | A | 0.07% |
| 4975 | G | A | 1.31% |
| 5017 | C | T | 0.42% |
| 5032 | G | A | 0.87% |
| 5099 | C | T | 0.47% |
| 5147 | G | A | 0.18% |
| 5185 | G | A | 0.36% |
| 5202 | C | T | 0.32% |
| 5206 | C | T | 3.91% |
| 5207 | C | T | 0.07% |
| 5213 | C | T | 0.35% |
| 5216 | C | T | 0.30% |
| 5218 | C | T | 0.09% |
| 5224 | G | A | 0.26% |
| 5270 | C | T | 0.26% |
| 5271 | G | A | 0.60% |
| 5297 | C | T | 0.18% |
| 5300 | C | T | 1.09% |

TABLE 5-continued

Unique off-target SNVs mediated by DdCBEs.

| SN position | Reference nucleotide | Altered nucleotide | Average % frequency |
|---|---|---|---|
| 5303 | C | T | 2.98% |
| 5312 | C | T | 0.33% |
| 5324 | C | T | 0.41% |
| 5330 | C | T | 0.10% |
| 5413 | G | A | 0.20% |
| 5444 | C | T | 0.08% |
| 5447 | C | T | 2.46% |
| 5448 | C | T | 0.39% |
| 5459 | C | T | 1.99% |
| 5532 | G | A | 0.44% |
| 5554 | C | T | 0.08% |
| 5591 | G | A | 0.67% |
| 5614 | C | T | 0.36% |
| 5660 | G | A | 0.36% |
| 5669 | G | A | 0.34% |
| 5790 | C | T | 0.78% |
| 5820 | C | T | 0.46% |
| 5822 | G | A | 0.07% |
| 5866 | C | T | 1.93% |
| 5875 | C | T | 0.20% |
| 5893 | C | T | 0.36% |
| 5903 | G | A | 0.70% |
| 5909 | C | T | 0.10% |
| 5913 | G | A | 1.46% |
| 5920 | G | A | 0.37% |
| 5950 | G | A | 0.23% |
| 5969 | C | T | 0.09% |
| 5987 | C | T | 1.00% |
| 6008 | C | T | 0.26% |
| 6015 | C | T | 0.11% |
| 6054 | G | A | 2.23% |
| 6062 | C | T | 0.18% |
| 6074 | C | T | 0.28% |
| 6077 | C | T | 2.66% |
| 6107 | C | T | 2.37% |
| 6122 | C | T | 0.21% |
| 6128 | C | T | 0.29% |
| 6130 | G | A | 0.35% |
| 6145 | G | A | 0.72% |
| 6164 | C | T | 0.49% |
| 6174 | G | A | 0.57% |
| 6211 | G | A | 0.20% |
| 6222 | C | T | 0.35% |
| 6242 | C | T | 0.14% |
| 6247 | C | T | 0.31% |
| 6258 | G | A | 0.39% |
| 6265 | G | A | 0.36% |
| 6271 | G | A | 0.36% |
| 6287 | C | T | 0.10% |
| 6294 | C | T | 0.12% |
| 6313 | C | T | 0.08% |
| 6322 | G | A | 0.07% |
| 6328 | C | T | 0.48% |
| 6347 | C | T | 0.07% |
| 6349 | C | T | 0.11% |
| 6368 | C | T | 0.43% |
| 6373 | C | T | 0.26% |
| 6398 | C | T | 0.51% |
| 6455 | C | T | 1.23% |
| 6458 | C | T | 2.26% |
| 6460 | G | A | 0.08% |
| 6463 | C | T | 1.96% |
| 6467 | C | T | 4.90% |
| 6473 | C | T | 0.33% |
| 6482 | C | T | 0.88% |
| 6506 | C | T | 1.07% |
| 6521 | C | T | 0.15% |
| 6537 | G | A | 0.19% |
| 6563 | C | T | 1.00% |
| 6564 | G | A | 0.71% |
| 6566 | C | T | 0.24% |
| 6573 | G | A | 0.40% |
| 6574 | G | A | 2.31% |
| 6577 | G | A | 1.18% |
| 6582 | G | A | 0.27% |

TABLE 5-continued

Unique off-target SNVs mediated by DdCBEs.

| SN position | Reference nucleotide | Altered nucleotide | Average % frequency |
|---|---|---|---|
| 6621 | C | T | 0.58% |
| 6627 | G | A | 0.09% |
| 6644 | C | T | 0.65% |
| 6656 | C | T | 0.62% |
| 6658 | G | A | 0.08% |
| 6688 | C | T | 0.09% |
| 6725 | C | T | 0.35% |
| 6734 | G | A | 0.07% |
| 6749 | C | T | 0.57% |
| 6761 | C | T | 0.24% |
| 6790 | G | A | 0.08% |
| 6795 | G | A | 0.61% |
| 6801 | G | A | 0.10% |
| 6808 | G | A | 0.08% |
| 6823 | C | T | 0.52% |
| 6839 | C | T | 0.72% |
| 6845 | C | T | 0.42% |
| 6857 | C | T | 2.06% |
| 6871 | G | A | 0.38% |
| 6889 | G | A | 0.44% |
| 6907 | C | T | 0.09% |
| 6931 | G | A | 0.07% |
| 6962 | G | A | 0.43% |
| 6988 | C | T | 0.38% |
| 6993 | G | A | 0.09% |
| 6998 | C | T | 1.08% |
| 7008 | G | A | 0.38% |
| 7034 | C | T | 0.35% |
| 7043 | C | T | 0.90% |
| 7070 | C | T | 0.13% |
| 7075 | G | A | 0.33% |
| 7119 | G | A | 1.72% |
| 7139 | C | T | 0.10% |
| 7160 | C | T | 1.31% |
| 7181 | C | T | 1.48% |
| 7204 | C | T | 1.13% |
| 7207 | G | A | 0.19% |
| 7216 | G | A | 3.45% |
| 7225 | C | T | 0.41% |
| 7227 | G | A | 1.83% |
| 7236 | G | A | 1.14% |
| 7259 | C | T | 1.19% |
| 7267 | C | T | 0.17% |
| 7331 | C | T | 0.20% |
| 7336 | C | T | 0.51% |
| 7337 | G | A | 0.12% |
| 7349 | C | T | 0.37% |
| 7369 | C | T | 0.19% |
| 7384 | G | A | 0.44% |
| 7393 | G | A | 0.95% |
| 7419 | G | A | 0.65% |
| 7444 | G | A | 0.99% |
| 7454 | G | A | 0.45% |
| 7458 | G | A | 0.07% |
| 7502 | C | T | 0.62% |
| 7506 | G | A | 0.09% |
| 7550 | C | T | 0.56% |
| 7573 | C | T | 0.11% |
| 7616 | G | A | 0.43% |
| 7626 | C | T | 0.46% |
| 7637 | G | A | 0.18% |
| 7658 | G | A | 0.39% |
| 7661 | C | T | 0.44% |
| 7669 | C | T | 0.08% |
| 7693 | C | T | 0.52% |
| 7699 | C | T | 1.76% |
| 7754 | G | A | 0.52% |
| 7777 | C | T | 1.16% |
| 7779 | G | A | 0.08% |
| 7786 | C | T | 0.48% |
| 7798 | C | T | 0.40% |
| 7801 | C | T | 1.92% |
| 7807 | C | T | 1.75% |
| 7810 | C | T | 0.36% |
| 7813 | C | T | 1.41% |

TABLE 5-continued

Unique off-target SNVs mediated by DdCBEs.

| SN position | Reference nucleotide | Altered nucleotide | Average % frequency |
|---|---|---|---|
| 7819 | C | T | 0.40% |
| 7824 | C | T | 0.97% |
| 7834 | C | T | 1.01% |
| 7847 | G | A | 1.17% |
| 7850 | G | A | 0.18% |
| 7855 | C | T | 0.49% |
| 7862 | C | T | 0.60% |
| 7866 | C | T | 0.35% |
| 7876 | C | T | 0.08% |
| 7919 | G | A | 1.30% |
| 7929 | G | A | 2.92% |
| 7939 | C | T | 0.10% |
| 7955 | C | T | 0.48% |
| 7979 | G | A | 0.40% |
| 7986 | G | A | 0.45% |
| 7994 | G | A | 1.03% |
| 8000 | G | A | 0.42% |
| 8020 | G | A | 0.23% |
| 8052 | C | T | 0.44% |
| 8057 | G | A | 0.30% |
| 8062 | C | T | 0.46% |
| 8080 | C | T | 0.79% |
| 8102 | G | A | 0.25% |
| 8115 | G | A | 5.88% |
| 8120 | C | T | 0.89% |
| 8148 | G | A | 1.16% |
| 8168 | C | T | 0.30% |
| 8187 | G | A | 0.28% |
| 8212 | C | T | 0.64% |
| 8215 | C | T | 6.92% |
| 8287 | C | T | 0.10% |
| 8428 | C | T | 0.07% |
| 8431 | C | T | 0.66% |
| 8434 | C | T | 1.14% |
| 8474 | C | T | 0.34% |
| 8478 | C | T | 0.38% |
| 8544 | C | T | 0.40% |
| 8549 | C | T | 0.09% |
| 8568 | C | T | 0.54% |
| 8592 | G | A | 0.21% |
| 8595 | C | T | 0.35% |
| 8605 | C | T | 0.09% |
| 8619 | C | T | 4.21% |
| 8620 | C | T | 0.11% |
| 8627 | C | T | 0.62% |
| 8635 | C | T | 0.34% |
| 8640 | C | T | 0.58% |
| 8648 | G | A | 1.05% |
| 8655 | C | T | 0.09% |
| 8669 | G | A | 0.31% |
| 8687 | C | T | 0.31% |
| 8720 | G | A | 11.41% |
| 8729 | G | A | 0.27% |
| 8747 | C | T | 0.08% |
| 8778 | C | T | 0.41% |
| 8781 | C | T | 0.91% |
| 8783 | G | A | 1.48% |
| 8844 | C | T | 1.76% |
| 8910 | C | T | 0.07% |
| 8940 | C | T | 1.00% |
| 8958 | C | T | 0.18% |
| 8967 | C | T | 0.19% |
| 9050 | G | A | 0.72% |
| 9085 | C | T | 0.50% |
| 9099 | C | T | 0.43% |
| 9102 | C | T | 0.08% |
| 9105 | C | T | 0.35% |
| 9123 | G | A | 0.30% |
| 9129 | C | T | 0.29% |
| 9144 | C | T | 1.17% |
| 9153 | C | T | 1.83% |
| 9196 | G | A | 1.19% |
| 9253 | G | A | 0.22% |
| 9281 | C | T | 1.03% |
| 9292 | C | T | 0.65% |

TABLE 5-continued

Unique off-target SNVs mediated by DdCBEs.

| SN position | Reference nucleotide | Altered nucleotide | Average % frequency |
|---|---|---|---|
| 9317 | C | T | 0.63% |
| 9335 | C | T | 0.42% |
| 9376 | G | A | 0.17% |
| 9384 | G | A | 1.73% |
| 9394 | G | A | 0.08% |
| 9431 | C | T | 1.83% |
| 9444 | C | T | 0.30% |
| 9445 | G | A | 0.13% |
| 9452 | G | A | 0.34% |
| 9458 | C | T | 0.36% |
| 9472 | C | T | 0.47% |
| 9488 | C | T | 0.94% |
| 9544 | G | A | 0.09% |
| 9569 | C | T | 0.39% |
| 9582 | C | T | 0.54% |
| 9593 | C | T | 1.01% |
| 9610 | C | T | 1.93% |
| 9620 | C | T | 0.10% |
| 9625 | C | T | 0.78% |
| 9657 | C | T | 0.07% |
| 9731 | C | T | 0.17% |
| 9742 | C | T | 0.15% |
| 9752 | C | T | 0.34% |
| 9764 | C | T | 0.08% |
| 9772 | C | T | 0.07% |
| 9774 | G | A | 2.59% |
| 9782 | C | T | 0.09% |
| 9815 | C | T | 0.96% |
| 9820 | G | A | 0.79% |
| 9825 | C | T | 0.24% |
| 9830 | C | T | 0.77% |
| 9851 | C | T | 0.90% |
| 9866 | C | T | 1.77% |
| 9892 | C | T | 2.30% |
| 9900 | C | T | 0.34% |
| 9911 | C | T | 0.47% |
| 9912 | G | A | 0.26% |
| 9942 | G | A | 0.23% |
| 9952 | G | A | 0.27% |
| 9968 | C | T | 0.10% |
| 9974 | C | T | 0.20% |
| 9979 | G | A | 0.07% |
| 10022 | C | T | 0.27% |
| 10038 | G | A | 0.08% |
| 10067 | C | T | 0.26% |
| 10094 | C | T | 0.35% |
| 10126 | G | A | 0.08% |
| 10181 | C | T | 0.46% |
| 10182 | G | A | 0.46% |
| 10184 | C | T | 0.10% |
| 10192 | C | T | 1.17% |
| 10205 | C | T | 6.66% |
| 10213 | C | T | 0.20% |
| 10257 | C | T | 0.37% |
| 10271 | C | T | 0.08% |
| 10327 | C | T | 0.15% |
| 10330 | C | T | 0.88% |
| 10346 | C | T | 0.34% |
| 10349 | C | T | 1.36% |
| 10362 | C | T | 0.28% |
| 10375 | G | A | 0.31% |
| 10387 | G | A | 0.64% |
| 10437 | G | A | 0.36% |
| 10478 | C | T | 0.12% |
| 10518 | C | T | 0.07% |
| 10536 | C | T | 0.33% |
| 10552 | C | T | 0.70% |
| 10555 | C | T | 0.69% |
| 10573 | G | A | 0.07% |
| 10585 | C | T | 0.07% |
| 10616 | C | T | 0.07% |
| 10664 | C | T | 0.08% |
| 10677 | G | A | 0.34% |
| 10706 | C | T | 0.18% |
| 10731 | G | A | 0.30% |

TABLE 5-continued

Unique off-target SNVs mediated by DdCBEs.

| SN position | Reference nucleotide | Altered nucleotide | Average % frequency |
|---|---|---|---|
| *10757* | *C* | *T* | *0.09%* |
| *10774* | *C* | *T* | *0.18%* |
| *10777* | *C* | *T* | *4.87%* |
| *10801* | *G* | *A* | *0.16%* |
| *10834* | *C* | *T* | *0.08%* |
| *10867* | *C* | *T* | *0.10%* |
| *10870* | *C* | *T* | *1.10%* |
| *10917* | *C* | *T* | *0.46%* |
| *10932* | *C* | *T* | *1.37%* |
| *10933* | *C* | *T* | *0.08%* |
| *10934* | *G* | *A* | *0.33%* |
| *10954* | *C* | *T* | *0.44%* |
| *10971* | *G* | *A* | *0.30%* |
| *10984* | *C* | *T* | *0.07%* |
| *11013* | *C* | *T* | *0.76%* |
| *11125* | *C* | *T* | *0.82%* |
| *11140* | *C* | *T* | *0.77%* |
| *11158* | *C* | *T* | *0.46%* |
| *11163* | *G* | *A* | *1.18%* |
| *11166* | *G* | *A* | *0.29%* |
| *11206* | *C* | *T* | *0.43%* |
| *11234* | *C* | *T* | *0.41%* |
| *11242* | *C* | *T* | *0.07%* |
| *11245* | *C* | *T* | *0.80%* |
| *11391* | *G* | *A* | *2.03%* |
| *11422* | *C* | *T* | *4.55%* |
| *11423* | *G* | *A* | *1.53%* |
| *11434* | *C* | *T* | *0.58%* |
| *11497* | *C* | *T* | *0.19%* |
| *11518* | *G* | *A* | *1.20%* |
| *11542* | *C* | *T* | *0.23%* |
| *11592* | *G* | *A* | *1.44%* |
| *11600* | *G* | *A* | *0.11%* |
| *11628* | *C* | *T* | *0.10%* |
| *11632* | *C* | *T* | *0.57%* |
| *11647* | *C* | *T* | *2.09%* |
| *11668* | *C* | *T* | *1.63%* |
| *11679* | *G* | *A* | *0.17%* |
| *11686* | *C* | *T* | *0.15%* |
| *11698* | *C* | *T* | *0.24%* |
| *11710* | *C* | *T* | *0.29%* |
| *11718* | *G* | *A* | *0.67%* |
| *11727* | *C* | *T* | *1.29%* |
| *11730* | *C* | *T* | *0.33%* |
| *11777* | *C* | *T* | *0.36%* |
| *11782* | *C* | *T* | *0.20%* |
| *11788* | *C* | *T* | *0.37%* |
| *11799* | *G* | *A* | *0.34%* |
| *11815* | *C* | *T* | *0.09%* |
| *11840* | *C* | *T* | *0.21%* |
| *11851* | *C* | *T* | *2.34%* |
| *11860* | *C* | *T* | *1.82%* |
| *11922* | *G* | *A* | *0.63%* |
| *11925* | *C* | *T* | *0.36%* |
| *11949* | *G* | *A* | *0.55%* |
| *11965* | *C* | *T* | *0.37%* |
| *12045* | *C* | *T* | *0.07%* |
| *12054* | *G* | *A* | *0.25%* |
| *12073* | *C* | *T* | *0.08%* |
| *12084* | *C* | *T* | *0.45%* |
| *12097* | *C* | *T* | *1.26%* |
| *12102* | *C* | *T* | *0.64%* |
| *12106* | *C* | *T* | *0.18%* |
| *12113* | *G* | *A* | *0.83%* |
| *12118* | *C* | *T* | *0.56%* |
| *12162* | *C* | *T* | *0.56%* |
| *12176* | *G* | *A* | *0.55%* |
| *12192* | *G* | *A* | *0.47%* |
| *12207* | *G* | *A* | *0.07%* |
| *12246* | *C* | *T* | *0.28%* |
| *12276* | *G* | *A* | *0.55%* |
| *12288* | *C* | *T* | *0.42%* |
| *12296* | *C* | *T* | *0.70%* |
| *12377* | *C* | *T* | *1.39%* |
| *12393* | *C* | *T* | *1.69%* |

TABLE 5-continued

Unique off-target SNVs mediated by DdCBEs.

| SN position | Reference nucleotide | Altered nucleotide | Average % frequency |
|---|---|---|---|
| *12405* | *C* | *T* | *0.30%* |
| *12449* | *C* | *T* | *0.91%* |
| *12456* | *C* | *T* | *2.06%* |
| *12461* | *C* | *T* | *2.48%* |
| *12474* | *C* | *T* | *0.32%* |
| *12478* | *C* | *T* | *0.08%* |
| *12483* | *C* | *T* | *1.15%* |
| *12508* | *G* | *A* | *0.72%* |
| *12583* | *G* | *A* | *0.65%* |
| *12591* | *C* | *T* | *0.73%* |
| *12593* | *C* | *T* | *0.46%* |
| *12606* | *C* | *T* | *0.90%* |
| *12621* | *C* | *T* | *0.44%* |
| *12632* | *C* | *T* | *4.47%* |
| *12636* | *C* | *T* | *0.32%* |
| *12667* | *G* | *A* | *0.07%* |
| *12682* | *C* | *T* | *0.37%* |
| *12690* | *C* | *T* | *0.29%* |
| *12708* | *C* | *T* | *0.60%* |
| *12759* | *C* | *T* | *0.14%* |
| *12762* | *C* | *T* | *1.29%* |
| *12788* | *C* | *T* | *0.48%* |
| *12806* | *G* | *A* | *0.10%* |
| *12818* | *G* | *A* | *0.42%* |
| *12823* | *G* | *A* | *0.20%* |
| *12852* | *C* | *T* | *0.30%* |
| *12867* | *C* | *T* | *0.46%* |
| *12871* | *G* | *A* | *0.45%* |
| *12876* | *C* | *T* | *0.54%* |
| *12885* | *C* | *T* | *1.96%* |
| *12888* | *C* | *T* | *0.71%* |
| *12906* | *C* | *T* | *0.45%* |
| *12925* | *G* | *A* | *0.30%* |
| *12958* | *C* | *T* | *1.18%* |
| *12966* | *C* | *T* | *0.09%* |
| *12984* | *C* | *T* | *0.40%* |
| *12987* | *C* | *T* | *0.43%* |
| *13007* | *C* | *T* | *0.09%* |
| *13021* | *C* | *T* | *0.17%* |
| *13031* | *G* | *A* | *0.38%* |
| *13040* | *C* | *T* | *0.36%* |
| *13065* | *C* | *T* | *0.20%* |
| *13119* | *C* | *T* | *2.25%* |
| *13125* | *C* | *T* | *0.91%* |
| *13155* | *C* | *T* | *0.71%* |
| *13185* | *C* | *T* | *0.07%* |
| *13197* | *C* | *T* | *0.23%* |
| *13206* | *C* | *T* | *0.10%* |
| *13230* | *C* | *T* | *0.43%* |
| *13250* | *C* | *T* | *0.36%* |
| *13261* | *C* | *T* | *0.08%* |
| *13268* | *G* | *A* | *0.50%* |
| *13287* | *C* | *T* | *0.26%* |
| *13293* | *C* | *T* | *0.50%* |
| *13323* | *C* | *T* | *0.42%* |
| *13341* | *C* | *T* | *0.20%* |
| *13364* | *C* | *T* | *0.19%* |
| *13370* | *C* | *1* | *1.68%* |
| *13374* | *C* | *T* | *0.29%* |
| *13377* | *C* | *T* | *1.61%* |
| *13393* | *G* | *A* | *0.18%* |
| *13415* | *G* | *A* | *0.21%* |
| *13418* | *G* | *A* | *0.86%* |
| *13445* | *C* | *T* | *0.17%* |
| *13451* | *C* | *T* | *0.19%* |
| *13455* | *C* | *T* | *0.07%* |
| *13481* | *G* | *A* | *0.07%* |
| *13494* | *C* | *T* | *0.88%* |
| *13508* | *C* | *T* | *0.18%* |
| *13513* | *G* | *A* | *0.24%* |
| *13521* | *C* | *T* | *0.80%* |
| *13524* | *C* | *T* | *0.97%* |
| *13578* | *C* | *T* | *0.90%* |
| *13586* | *C* | *T* | *0.33%* |
| *13590* | *G* | *A* | *0.70%* |

TABLE 5-continued

Unique off-target SNVs mediated by DdCBEs.

| SN position | Reference nucleotide | Altered nucleotide | Average % frequency |
|---|---|---|---|
| 13636 | C | T | 0.21% |
| 13642 | C | T | 0.24% |
| 13647 | C | T | 0.92% |
| 13715 | G | A | 1.01% |
| 13754 | C | T | 0.25% |
| 13763 | C | T | 5.08% |
| 13764 | C | T | 0.07% |
| 13770 | C | T | 1.28% |
| 13782 | C | T | 0.83% |
| 13809 | C | T | 0.09% |
| 13815 | C | T | 0.16% |
| 13826 | G | A | 0.23% |
| 13843 | G | A | 0.07% |
| 13880 | C | T | 0.07% |
| 13947 | C | T | 0.16% |
| 13992 | C | T | 1.62% |
| 13996 | G | A | 0.47% |
| 14006 | G | A | 0.49% |
| 14057 | C | T | 0.39% |
| 14061 | C | T | 0.27% |
| 14064 | C | T | 0.79% |
| 14100 | C | T | 0.38% |
| 14115 | C | T | 1.22% |
| 14124 | C | T | 2.34% |
| 14142 | C | T | 0.09% |
| 14155 | C | T | 0.32% |
| 14160 | G | A | 0.37% |
| 14259 | G | A | 0.11% |
| 14262 | C | T | 0.30% |
| 14265 | C | T | 0.81% |
| 14279 | G | A | 0.54% |
| 14292 | C | T | 0.17% |
| 14309 | C | T | 0.99% |
| 14346 | C | T | 0.35% |
| 14372 | C | T | 0.40% |
| 14379 | C | T | 0.43% |
| 14383 | C | T | 0.34% |
| 14438* | G* | A* | 17.85%* |
| 14439* | G* | A* | 20.74%* |
| 14443* | C* | T* | 3.43%* |
| 14445* | C* | T* | 13.25%* |
| 14446 | C | T | 0.20% |
| 14448 | C | T | 0.09% |
| 14471 | C | T | 0.81% |
| 14485 | C | T | 0.21% |
| 14531 | C | T | 0.53% |
| 14560 | G | A | 2.54% |
| 14601 | G | A | 0.51% |
| 14612 | G | A | 0.10% |
| 14671 | C | T | 0.26% |
| 14686 | G | A | 2.60% |
| 14698 | G | A | 4.24% |
| 14720 | C | T | 0.52% |
| 14749 | G | A | 0.20% |
| 14796 | C | T | 0.18% |
| 14803 | C | T | 0.94% |
| 14804 | G | A | 1.80% |
| 14806 | C | T | 0.32% |
| 14809 | C | T | 3.13% |
| 14810 | C | T | 0.89% |
| 14820 | C | T | 4.50% |
| 14827 | C | T | 0.26% |
| 14829 | C | T | 0.30% |
| 14835 | G | A | 0.48% |
| 14845 | C | T | 0.19% |
| 14854 | C | T | 0.08% |
| 14869 | G | A | 0.18% |
| 14872 | C | T | 2.53% |
| 14875 | C | T | 1.47% |
| 14889 | G | A | 1.35% |
| 14896 | C | T | 0.08% |
| 14918 | G | A | 0.65% |
| 14925 | C | T | 0.11% |
| 14940 | C | T | 0.34% |
| 14944 | C | T | 0.33% |
| 14953 | C | T | 0.66% |
| 14960 | G | A | 0.56% |
| 14983 | C | T | 3.36% |
| 14993 | C | T | 0.32% |
| 15009 | C | T | 0.30% |
| 15031 | C | T | 1.39% |
| 15040 | C | T | 2.78% |
| 15045 | G | A | 0.11% |
| 15060 | G | A | 1.48% |
| 15091 | C | T | 1.34% |
| 15100 | C | T | 0.60% |
| 15103 | C | T | 1.37% |
| 15142 | C | T | 1.18% |
| 15145 | C | T | 0.85% |
| 15150 | G | A | 0.34% |
| 15198 | C | T | 0.85% |
| 15205 | C | T | 1.24% |
| 15221 | G | A | 0.07% |
| 15240 | G | A | 0.45% |
| 15257 | G | A | 0.07% |
| 15263 | C | T | 0.81% |
| 15271 | C | T | 0.07% |
| 15295 | C | T | 0.18% |
| 15298 | C | T | 0.16% |
| 15337 | C | T | 0.49% |
| 15357 | G | A | 1.63% |
| 15384 | C | T | 1.34% |
| 15385 | C | T | 0.34% |
| 15390 | C | T | 0.08% |
| 15392 | G | A | 0.20% |
| 15406 | C | T | 0.81% |
| 15428 | G | A | 0.10% |
| 15436 | C | T | 0.19% |
| 15451 | C | T | 0.96% |
| 15493 | C | T | 0.26% |
| 15500 | G | A | 0.31% |
| 15506 | G | A | 0.51% |
| 15542 | C | T | 0.40% |
| 15550 | C | T | 1.32% |
| 15574 | C | T | 0.07% |
| 15591 | G | A | 0.43% |
| 15594 | C | T | 0.84% |
| 15598 | C | T | 3.60% |
| 15612 | G | A | 0.31% |
| 15619 | C | T | 3.41% |
| 15636 | C | T | 0.45% |
| 15640 | C | T | 0.72% |
| 15643 | C | T | 0.21% |
| 15646 | C | T | 1.05% |
| 15664 | C | T | 0.53% |
| 15667 | C | T | 0.35% |
| 15675 | C | T | 6.13% |
| 15676 | C | T | 0.15% |
| 15737 | G | A | 0.09% |
| 15742 | C | T | 0.34% |
| 15745 | C | T | 0.24% |
| 15760 | C | T | 0.09% |
| 15762 | G | A | 0.65% |
| 15765 | G | A | 1.26% |
| 15793 | C | T | 0.07% |
| 15798 | G | A | 1.94% |
| 15810 | C | T | 0.75% |
| 15832 | C | T | 0.08% |
| 15838 | C | T | 0.33% |
| 15890 | C | T | 0.77% |
| 15928 | G | A | 0.09% |
| 15930 | G | A | 0.10% |
| 15950 | G | A | 1.83% |
| 15957 | C | T | 0.07% |
| 16036 | G | A | 0.27% |
| 16173 | C | T | 0.26% |
| 16179 | C | T | 0.29% |
| 16193 | C | T | 0.19% |
| 16239 | C | T | 0.07% |
| 16363 | C | T | 3.22% |

TABLE 5-continued

Unique off-target SNVs mediated by DdCBEs.

| SN position | Reference nucleotide | Altered nucleotide | Average % frequency |
|---|---|---|---|
| 16370 | G | A | 0.09% |
| 16393 | C | T | 15.92% |
| 16394 | C | T | 2.80% |
| 16407 | C | T | 0.82% |
| 16410 | C | T | 0.63% |
| 16425 | C | T | 0.44% |
| 16449 | C | T | 0.70% |
| 16494 | C | T | 0.39% |
| 16496 | G | A | 0.41% |
| 16501 | C | T | 0.62% |
| 16563 | C | T | 0.59% |
| 64 | C | T | 0.10% |
| 505 | C | T | 0.60% |
| 660 | C | T | 1.09% |
| 705 | C | T | 0.12% |
| 740 | G | A | 0.09% |
| 1227 | G | A | 0.28% |
| 1491 | C | T | 0.38% |
| 1595 | G | A | 0.62% |
| 1709 | G | A | 0.30% |
| 1831 | G | A | 0.40% |
| 1913 | G | A | 0.33% |
| 1990 | G | A | 0.19% |
| 2024 | C | T | 0.36% |
| 2100 | C | T | 0.09% |
| 2269 | G | A | 0.69% |
| 2347 | C | T | 0.27% |
| 2523 | C | T | 0.27% |
| 2716 | G | A | 0.37% |
| 2899 | C | T | 0.10% |
| 2989 | G | A | 0.08% |
| 2996 | G | A | 0.31% |
| 3007 | C | T | 0.44% |
| 3132 | G | A | 0.17% |
| 3351 | C | T | 0.16% |
| 3457 | G | A | 0.55% |
| 3522 | C | T | 0.08% |
| 3594 | C | T | 0.28% |
| 3662 | C | T | 0.08% |
| 3696 | C | T | 0.41% |
| 3920 | C | T | 0.21% |
| 4048 | G | A | 0.19% |
| 4153 | G | A | 0.54% |
| 4333 | G | A | 0.17% |
| 4397 | C | T | 0.19% |
| 4493 | C | T | 0.08% |
| 4526 | C | T | 0.16% |
| 4669 | C | T | 0.30% |
| 4714 | G | A | 0.42% |
| 4846 | C | T | 0.96% |
| 4975 | G | A | 0.07% |
| 5032 | G | A | 0.07% |
| 5099 | C | T | 0.26% |
| 5206 | C | T | 0.31% |
| 5300 | C | T | 0.14% |
| 5303 | C | T | 2.28% |
| 5447 | C | T | 0.40% |
| 5459 | C | T | 0.38% |
| 5866 | C | I | 0.27% |
| 5875 | C | T | 0.07% |
| 5913 | G | A | 0.26% |
| 5987 | C | T | 0.23% |
| 6054 | G | A | 0.08% |
| 6077 | C | T | 0.53% |
| 6128 | C | T | 0.16% |
| 6398 | C | T | 0.19% |
| 6455 | C | T | 0.31% |
| 6458 | C | T | 0.27% |
| 6463 | C | T | 0.30% |
| 6467 | C | T | 0.76% |
| 6563 | C | T | 0.14% |
| 6574 | G | A | 0.37% |
| 6839 | C | T | 0.23% |
| 6857 | C | T | 0.18% |
| 6998 | C | T | 0.32% |

TABLE 5-continued

Unique off-target SNVs mediated by DdCBEs.

| SN position | Reference nucleotide | Altered nucleotide | Average % frequency |
|---|---|---|---|
| 7119 | G | A | 0.28% |
| 7160 | C | T | 0.34% |
| 7181 | C | T | 0.51% |
| 7204 | C | T | 0.32% |
| 7216 | G | A | 0.73% |
| 7227 | G | A | 0.20% |
| 7236 | G | A | 0.07% |
| 7259 | C | T | 0.07% |
| 7336 | C | T | 0.25% |
| 7393 | G | A | 0.10% |
| 7699 | C | T | 0.21% |
| 7801 | C | T | 0.38% |
| 7807 | C | T | 0.37% |
| 7813 | C | T | 0.35% |
| 7824 | C | T | 0.19% |
| 7834 | C | T | 0.17% |
| 7847 | G | A | 0.27% |
| 7919 | G | A | 0.07% |
| 7929 | G | A | 0.39% |
| 7994 | G | A | 0.20% |
| 8115 | G | A | 1.20% |
| 8120 | C | T | 0.17% |
| 8212 | C | T | 0.10% |
| 8215 | C | T | 1.49% |
| 8619 | C | T | 0.89% |
| 8648 | G | A | 0.33% |
| 8720 | G | A | 1.29% |
| 8781 | C | T | 0.17% |
| 8783 | G | A | 0.15% |
| 8844 | C | T | 0.40% |
| 9144 | C | T | 0.09% |
| 9153 | C | T | 0.84% |
| 9384 | G | A | 0.24% |
| 9431 | C | T | 0.39% |
| 9488 | C | T | 0.31% |
| 9610 | C | T | 0.24% |
| 9774 | G | A | 0.50% |
| 9815 | C | T | 0.10% |
| 9830 | C | T | 0.08% |
| 9851 | C | T | 0.26% |
| 9866 | C | T | 0.08% |
| 9892 | C | T | 0.32% |
| 9942 | G | A | 0.07% |
| 9952 | G | A | 0.28% |
| 10192 | C | T | 0.29% |
| 10205 | C | T | 1.53% |
| 10330 | C | T | 0.11% |
| 10349 | C | T | 0.26% |
| 10387 | G | A | 0.11% |
| 10552 | C | T | 0.08% |
| 10555 | C | T | 0.08% |
| 10777 | C | T | 0.77% |
| 10932 | C | I | 0.26% |
| 11013 | C | T | 0.09% |
| 11140 | C | T | 0.15% |
| 11163 | G | A | 0.29% |
| 11518 | G | A | 0.20% |
| 11592 | G | A | 0.13% |
| 11668 | C | T | 0.35% |
| 11727 | C | T | 0.35% |
| 11799 | G | A | 1.05% |
| 11804 | C | T | 0.53% |
| 12084 | C | T | 0.07% |
| 12296 | C | T | 0.08% |
| 12393 | C | I | 0.16% |
| 12456 | C | T | 0.51% |
| 12461 | C | T | 0.44% |
| 12483 | C | T | 0.07% |
| 12606 | C | T | 0.14% |
| 12632 | C | T | 0.99% |
| 12762 | C | T | 0.17% |
| 12885 | C | T | 0.18% |
| 12888 | C | T | 0.08% |
| 13119 | C | T | 0.36% |
| 13370 | C | T | 0.40% |

TABLE 5-continued

Unique off-target SNVs mediated by DdCBEs.

| SN position | Reference nucleotide | Altered nucleotide | Average % frequency |
|---|---|---|---|
| 13377 | C | T | 0.67% |
| 13445 | C | T | 0.08% |
| 13494* | C* | T* | 33.00%* |
| 13496 | C | T | 0.56% |
| 13578 | C | T | 0.31% |
| 13590 | G | A | 0.44% |
| 13647 | C | T | 0.37% |
| 13763 | C | T | 0.95% |
| 13770 | C | T | 0.09% |
| 13782 | C | T | 0.08% |
| 13992 | C | T | 0.33% |
| 14006 | G | A | 0.08% |
| 14124 | C | T | 0.48% |
| 14265 | C | T | 0.08% |
| 14383 | C | T | 0.08% |
| 14560 | G | A | 0.69% |
| 14686 | G | A | 0.51% |
| 14698 | G | A | 0.63% |
| 14803 | C | T | 0.20% |
| 14820 | C | T | 0.40% |
| 14872 | C | T | 0.35% |
| 14875 | C | T | 0.31% |
| 14983 | C | T | 0.64% |
| 15031 | C | T | 0.19% |
| 15040 | C | T | 1.67% |
| 15060 | G | A | 0.09% |
| 15091 | C | T | 0.36% |
| 15103 | C | T | 0.22% |
| 15142 | C | T | 0.21% |
| 15198 | C | T | 0.07% |
| 15205 | C | T | 0.16% |
| 15357 | G | A | 0.28% |
| 15550 | C | T | 0.28% |
| 15594 | C | T | 0.33% |
| 15598 | C | T | 0.80% |
| 15619 | C | T | 0.58% |
| 15646 | C | T | 0.21% |
| 15664 | C | T | 0.20% |
| 15765 | G | A | 0.18% |
| 15798 | G | A | 0.23% |
| 15810 | C | T | 0.16% |
| 15950 | G | A | 0.36% |
| 16363 | C | T | 0.61% |
| 16449 | C | T | 0.16% |
| 933 | G | A | 0.09% |
| 1227 | G | A | 0.07% |
| 1625 | A | G | 0.07% |
| 3457 | G | A | 0.16% |
| 3696 | C | T | 0.19% |
| 4846 | C | T | 0.30% |
| 6876 | G | A | 0.07% |
| 7160 | C | T | 0.08% |
| 7216 | G | A | 0.10% |
| 8115 | G | A | 0.20% |
| 8148 | G | A | 0.07% |
| 8215 | C | T | 0.07% |
| 8720 | G | A | 0.16% |
| 9343 | G | A | 0.07% |
| 9384 | G | A | 0.20% |
| 9565 | G | A | 0.14% |
| 9774 | G | A | 0.07% |
| 10205 | C | T | 0.10% |
| 12145 | T | C | 0.18% |
| 12632 | C | T | 0.09% |
| 12871 | G | A | 0.07% |
| 13451 | C | T | 8.44% |
| 13452 | C | T | 5.89% |
| 13763 | C | T | 0.42% |
| 14560 | G | A | 0.08% |
| 14588 | C | T | 0.24% |
| 15040 | C | T | 0.19% |
| 933 | G | A | 0.09% |
| 1227 | G | A | 0.07% |
| 1625 | A | G | 0.07% |
| 3457 | G | A | 0.16% |

TABLE 5-continued

Unique off-target SNVs mediated by DdCBEs.

| SN position | Reference nucleotide | Altered nucleotide | Average % frequency |
|---|---|---|---|
| 3696 | C | T | 0.19% |
| 4846 | C | T | 0.30% |
| 6876 | G | A | 0.07% |
| 7160 | C | T | 0.08% |
| 7216 | G | A | 0.10% |
| 8115 | G | A | 0.20% |
| 8148 | G | A | 0.07% |
| 8215 | C | T | 0.07% |
| 8720 | G | A | 0.16% |
| 9343 | G | A | 0.07% |
| 9384 | G | A | 0.20% |
| 9565 | G | A | 0.14% |
| 9774 | G | A | 0.07% |
| 10205 | C | T | 0.10% |
| 12145 | T | C | 0.18% |
| 12632 | C | T | 0.09% |
| 12871 | G | A | 0.07% |
| 13451 | C | T | 8.44% |
| 13452 | C | T | 5.89% |
| 13763 | C | T | 0.42% |
| 14560 | G | A | 0.08% |
| 14588 | C | T | 0.24% |
| 15040 | C | T | 0.19% |
| 933 | G | A | 0.09% |
| 1227 | G | A | 0.07% |
| 1625 | A | G | 0.07% |
| 3457 | G | A | 0.16% |
| 3696 | C | T | 0.19% |
| 4846 | C | T | 0.30% |
| 6876 | G | A | 0.07% |
| 7160 | C | T | 0.08% |
| 7216 | G | A | 0.10% |
| 8115 | G | A | 0.20% |
| 8148 | G | A | 0.07% |
| 8215 | C | T | 0.07% |
| 8720 | G | A | 0.16% |
| 9343 | G | A | 0.07% |
| 9384 | G | A | 0.20% |
| 9565 | G | A | 0.14% |
| 9774 | G | A | 0.07% |
| 10205 | C | T | 0.10% |
| 12145 | T | C | 0.18% |
| 12632 | C | T | 0.09% |
| 12871 | G | A | 0.07% |
| 13451* | C* | T* | 8.44%* |
| 13452* | C* | T* | 5.89%* |
| 13763 | C | T | 0.42% |
| 14560 | G | A | 0.08% |
| 14588 | C | T | 0.24% |
| 15040 | C | T | 0.19% |
| 546 | A | C | 0.11% |
| 574 | A | C | 0.12% |
| 1623 | G | A | 0.24% |
| 8115 | G | A | 0.09% |
| 11922* | G* | A* | 26.41%* |
| 11925 | C | T | 0.08% |
| 12145 | T | C | 0.09% |
| 13111 | T | C | 0.08% |
| 550 | A | C | 0.21% |
| 660 | C | T | 0.20% |
| 933 | G | A | 0.08% |
| 1169 | G | A | 0.00% |
| 1227 | G | A | 0.09% |
| 1415 | G | A | 0.76% |
| 1422 | G | A | 0.14% |
| 2948 | C | T | 0.61% |
| 3594 | C | T | 0.28% |
| 3696 | C | T | 0.09% |
| 5532 | G | A | 0.34% |
| 6467 | C | T | 0.08% |
| 6621 | C | T | 0.09% |
| 6876 | G | A | 0.09% |
| 7216 | G | A | 0.40% |
| 8115 | G | A | 0.09% |
| 8215 | C | T | 0.42% |

TABLE 5-continued

Unique off-target SNVs mediated by DdCBEs.

| SN position | Reference nucleotide | Altered nucleotide | Average % frequency |
|---|---|---|---|
| 8474* | C* | T* | 7.21%* |
| 8475* | C* | T* | 3.64%* |
| 8844 | C | T | 0.97% |
| 8886 | G | A | 0.08% |
| 9384 | G | A | 0.81% |
| 10205 | C | T | 0.16% |
| 12632 | C | T | 0.18% |
| 12682 | C | T | 0.16% |
| 13377 | C | T | 0.27% |
| 14588 | C | T | 0.18% |
| 15031 | C | T | 0.65% |
| 15040 | C | T | 0.08% |
| 15205 | C | T | 0.08% |
| 15950 | G | A | 0.97% |

SNVs called by VarScan 2 were considered high-confidence if the percentage frequency of a given SNV is >0.1% in one or more replicates. Shown are all the unique SNVs across three independent biological replicates. SNV positions for each DdCBE treatment (ND6-DdCBE, italics; ND5.1-DdCBE, italics, underline; ND5.2 DdCBE, bold; ND4-DdCBE, bold, underlined; ATP8-DdCBE, bold, italics) were from the NC_012920 reference genome. On-target SNVs are marked by asterisks.

TABLE 6

Overlapping off-target SNVs.
Shown are the list of overlapping off-target SNVs between ND6- and ND5.1-DdCBE (italics), ND6-, ND5.1- and ATP8-DdCBE (bold) and ND6-, ND5.1-, ND5.2- and ATP8-DdCBE (underlined). The average frequencies for the respective DdCBEs are shown.

| | Average % frequency | | | |
|---|---|---|---|---|
| SNV position | ND6-DdCBE | ND5.1-DdCBE | ND5.2-DdCBE | ATP8-DdCBE |
| *64* | *1.34%* | *0.10%* | | |
| *505* | *1.74%* | *0.60%* | | |
| *705* | *1.13%* | *0.12%* | | |
| *740* | *1.34%* | *0.09%* | | |
| *1491* | *1.61%* | *0.38%* | | |
| *1595* | *4.53%* | *0.62%* | | |
| *1709* | *0.49%* | *0.30%* | | |
| *1831* | *1.35%* | *0.40%* | | |
| *1913* | *2.41%* | *0.33%* | | |
| *1990* | *1.59%* | *0.19%* | | |
| *2024* | *2.23%* | *0.36%* | | |
| *2100* | *1.99%* | *0.09%* | | |
| *2269* | *2.45%* | *0.69%* | | |
| *2347* | *1.64%* | *0.27%* | | |
| *2523* | *0.50%* | *0.27%* | | |
| *2716* | *1.07%* | *0.37%* | | |
| *2899* | *1.09%* | *0.10%* | | |
| *2989* | *1.08%* | *0.08%* | | |
| *2996* | *1.73%* | *0.31%* | | |
| *3007* | *2.38%* | *0.44%* | | |
| *3132* | *1.40%* | *0.17%* | | |
| *3351* | *0.51%* | *0.16%* | | |
| *3522* | *1.13%* | *0.08%* | | |
| *3662* | *0.76%* | *0.08%* | | |
| *3920* | *1.20%* | *0.21%* | | |
| *4048* | *1.02%* | *0.19%* | | |
| *4153* | *1.98%* | *0.54%* | | |
| *4333* | *0.95%* | *0.17%* | | |
| *4397* | *1.10%* | *0.19%* | | |
| *4493* | *1.40%* | *0.08%* | | |
| *4526* | *0.63%* | *0.16%* | | |
| *4669* | *2.96%* | *0.30%* | | |
| *4714* | *2.27%* | *0.42%* | | |
| *4975* | *1.31%* | *0.07%* | | |
| *5032* | *0.87%* | *0.07%* | | |
| *5099* | *0.47%* | *0.26%* | | |
| *5206* | *3.91%* | *0.31%* | | |
| *5300* | *1.09%* | *0.14%* | | |
| *5303* | *2.98%* | *2.28%* | | |
| *5447* | *2.46%* | *0.40%* | | |
| *5459* | *1.99%* | *0.38%* | | |
| *5866* | *1.93%* | *0.27%* | | |
| *5875* | *0.20%* | *0.07%* | | |
| *5913* | *1.46%* | *0.26%* | | |
| *5987* | *1.00%* | *0.23%* | | |
| *6054* | *2.23%* | *0.08%* | | |
| *6077* | *2.66%* | *0.53%* | | |
| *6128* | *0.29%* | *0.16%* | | |
| *6398* | *0.51%* | *0.19%* | | |
| *6455* | *1.23%* | *0.31%* | | |

TABLE 6-continued

Overlapping off-target SNVs.
Shown are the list of overlapping off-target SNVs between ND6- and ND5.1-DdCBE (italics), ND6-, ND5.1- and ATP8-DdCBE (bold) and ND6-, ND5.1-, ND5.2- and ATP8-DdCBE (underlined). The average frequencies for the respective DdCBEs are shown.

| | Average % frequency | | | |
|---|---|---|---|---|
| SNV position | ND6-DdCBE | ND5.1-DdCBE | ND5.2-DdCBE | ATP8-DdCBE |
| *6458* | *2.26%* | *0.27%* | | |
| *6463* | *1.96%* | *0.30%* | | |
| *6563* | *1.00%* | *0.14%* | | |
| *6574* | *2.31%* | *0.37%* | | |
| *6839* | *0.72%* | *0.23%* | | |
| *6857* | *2.06%* | *0.18%* | | |
| *6998* | *1.08%* | *0.32%* | | |
| *7119* | *1.72%* | *0.28%* | | |
| *7181* | *1.48%* | *0.51%* | | |
| *7204* | *1.13%* | *0.32%* | | |
| *7227* | *1.83%* | *0.20%* | | |
| *7236* | *1.14%* | *0.07%* | | |
| *7259* | *1.19%* | *0.07%* | | |
| *7336* | *0.51%* | *0.25%* | | |
| *7393* | *0.95%* | *0.10%* | | |
| *7699* | *1.76%* | *0.21%* | | |
| *7801* | *1.92%* | *0.38%* | | |
| *7807* | *1.75%* | *0.37%* | | |
| *7813* | *1.41%* | *0.35%* | | |
| *7824* | *0.97%* | *0.19%* | | |
| *7834* | *1.01%* | *0.17%* | | |
| *7847* | *1.17%* | *0.27%* | | |
| *7919* | *1.30%* | *0.07%* | | |
| *7929* | *2.92%* | *0.39%* | | |
| *7994* | *1.03%* | *0.20%* | | |
| *8120* | *0.89%* | *0.17%* | | |
| *8212* | *0.64%* | *0.10%* | | |
| *8619* | *4.21%* | *0.89%* | | |
| *8648* | *1.05%* | *0.33%* | | |
| *8781* | *0.91%* | *0.17%* | | |
| *8783* | *1.48%* | *0.15%* | | |
| *9144* | *1.17%* | *0.09%* | | |
| *9153* | *1.83%* | *0.84%* | | |
| *9431* | *1.83%* | *0.39%* | | |
| *9488* | *0.94%* | *0.31%* | | |
| *9610* | *1.93%* | *0.24%* | | |
| *9815* | *0.96%* | *0.10%* | | |
| *9830* | *0.77%* | *0.08%* | | |
| *9851* | *0.90%* | *0.26%* | | |
| *9866* | *1.77%* | *0.08%* | | |
| *9892* | *2.30%* | *0.32%* | | |
| *9942* | *0.23%* | *0.07%* | | |
| *9952* | *0.27%* | *0.28%* | | |
| *10192* | *1.17%* | *0.29%* | | |
| *10330* | *0.88%* | *0.11%* | | |
| *10349* | *1.36%* | *0.26%* | | |
| *10387* | *0.64%* | *0.11%* | | |
| *10552* | *0.70%* | *0.08%* | | |
| *10555* | *0.69%* | *0.08%* | | |
| *10777* | *4.87%* | *0.77%* | | |
| *10932* | *1.37%* | *0.26%* | | |
| *11013* | *0.76%* | *0.09%* | | |
| *11140* | *0.77%* | *0.15%* | | |
| *11163* | *1.18%* | *0.29%* | | |
| *11518* | *1.20%* | *0.20%* | | |
| *11592* | *1.44%* | *0.13%* | | |
| *11668* | *1.63%* | *0.35%* | | |
| *11727* | *1.29%* | *0.35%* | | |
| *11799* | *0.34%* | *1.05%* | | |
| *12084* | *0.45%* | *0.07%* | | |
| *12296* | *0.70%* | *0.08%* | | |
| *12393* | *1.69%* | *0.16%* | | |
| *12456* | *2.06%* | *0.51%* | | |
| *12461* | *2.48%* | *0.44%* | | |
| *12483* | *1.15%* | *0.07%* | | |
| *12606* | *0.90%* | *0.14%* | | |
| *12762* | *1.29%* | *0.17%* | | |
| *12885* | *1.96%* | *0.18%* | | |
| *12888* | *0.71%* | *0.08%* | | |
| *13119* | *2.25%* | *0.36%* | | |

TABLE 6-continued

Overlapping off-target SNVs.
Shown are the list of overlapping off-target SNVs between ND6- and ND5.1-DdCBE (italics), ND6-, ND5.1- and ATP8-DdCBE (bold) and ND6-, ND5.1-, ND5.2- and ATP8-DdCBE (underlined). The average frequencies for the respective DdCBEs are shown.

| | Average % frequency | | | |
|---|---|---|---|---|
| SNV position | ND6-DdCBE | ND5.1-DdCBE | ND5.2-DdCBE | ATP8-DdCBE |
| *13370* | *1.68%* | *0.40%* | | |
| *13445* | *0.17%* | *0.08%* | | |
| *13494* | *0.88%* | *33.00%* | | |
| *13578* | *0.90%* | *0.31%* | | |
| *13590* | *0.70%* | *0.44%* | | |
| *13647* | *0.92%* | *0.37%* | | |
| *13770* | *1.28%* | *0.09%* | | |
| *13782* | *0.83%* | *0.08%* | | |
| *13992* | *1.62%* | *0.33%* | | |
| *14006* | *0.49%* | *0.08%* | | |
| *14124* | *2.34%* | *0.48%* | | |
| *14265* | *0.81%* | *0.08%* | | |
| *14383* | *0.34%* | *0.08%* | | |
| *14686* | *2.60%* | *0.51%* | | |
| *14698* | *4.24%* | *0.63%* | | |
| *14803* | *0.94%* | *0.20%* | | |
| *14820* | *4.50%* | *0.40%* | | |
| *14872* | *2.53%* | *0.35%* | | |
| *14875* | *1.47%* | *0.31%* | | |
| *14983* | *3.36%* | *0.64%* | | |
| *15060* | *1.48%* | *0.09%* | | |
| *15091* | *1.34%* | *0.36%* | | |
| *15103* | *1.37%* | *0.22%* | | |
| *15142* | *1.18%* | *0.21%* | | |
| *15198* | *0.85%* | *0.07%* | | |
| *15357* | *1.63%* | *0.28%* | | |
| *15550* | *1.32%* | *0.28%* | | |
| *15594* | *0.84%* | *0.33%* | | |
| *15598* | *3.60%* | *0.80%* | | |
| *15619* | *3.41%* | *0.58%* | | |
| *15646* | *1.05%* | *0.21%* | | |
| *15664* | *0.53%* | *0.20%* | | |
| *15765* | *1.26%* | *0.18%* | | |
| *15798* | *1.94%* | *0.23%* | | |
| *15810* | *0.75%* | *0.16%* | | |
| *16363* | *3.22%* | *0.61%* | | |
| *16449* | *0.70%* | *0.16%* | | |
| **660** | **5.79%** | **1.09%** | | **0.20%** |
| **3594** | **2.49%** | **0.28%** | | **0.28%** |
| **6467** | **4.90%** | **0.76%** | | **0.08%** |
| **8844** | **1.76%** | **0.40%** | | **0.97%** |
| **13377** | **1.61%** | **0.67%** | | **0.27%** |
| **15031** | **1.39%** | **0.19%** | | **0.65%** |
| **15205** | **1.24%** | **0.16%** | | **0.08%** |
| **15950** | **1.83%** | **0.36%** | | **0.97%** |
| 1227 | 1.69% | 0.28% | 0.07% | 0.09% |
| 3696 | 2.02% | 0.41% | 0.19% | 0.09% |
| 7216 | 3.45% | 0.73% | 0.10% | 0.40% |
| 8215 | 6.92% | 1.49% | 0.07% | 0.42% |
| 9384 | 1.73% | 0.24% | 0.20% | 0.81% |
| 10205 | 6.66% | 1.53% | 0.10% | 0.16% |
| 12632 | 4.47% | 0.99% | 0.09% | 0.18% |
| 15040 | 2.78% | 1.67% | 0.19% | 0.08% |

TABLE 7

Disease-associated mitochondrial DNA point mutations. Pathogenic mtDNA point mutations were obtained from the MITOMAP database12 (accessed Dec. 10, 2019). Disease-associated mutations in rRNA/tRNA and coding/non-coding regions were considered only if they had been assigned 'Cfrm' statuses. Italics: SNPs that are corrected by C•G-to-T•A conversions; Underlined: SNPs that are corrected by A•T-to-G•C conversions; Bold, underlined: SNPs that are corrected by A•T-to-C•G conversions; Bold, italics: SNPs that are corrected by C•G-to-G•C conversions; Italics, underlined: SNPs that are corrected by A•T-to-T•A conversions

| Allele SNP | Locus | Associated disease |
|---|---|---|
| *T616C* | *MT-TF* | *Maternally inherited epilepsy/kidney disease* |
| *A1555G* | *MT-RNR1* | *DEAF; autism spectrum intellectual disability; possibly antiatherosclerotic* |
| *A1630G* | *MT-TV* | *MNGIE-like disease/MELAS* |
| *A3243G* | *MT-TL1* | *MELAS/LS/DMDF/MIDD/SNHL/CPEO/MM/FSGS/ASD/ Cardiac + multi-organ dysfunction* |
| *T3258C* | *MT-TL1* | *MELAS/Myopathy* |
| *A3260G* | *MT-TL1* | *MMC/MELAS* |
| *T3271C* | *MT-TL1* | *MELAS/DM* |
| *A3280G* | *MT-TL1* | *Myopathy* |
| *T3291C* | *MT-TL1* | *MELAS/Myopathy/Deafness + Cognitive Impairment* |
| *A3302G* | *MT-TL1* | *MM* |
| *A4300G* | *MT-TI* | *MICM* |
| *A5690G* | *MT-TN* | *CPEO + ptosis + proximal myopathy* |
| *T5728C* | *MT-TN* | *Multiorgan failure/myopathy* |
| *A7445G* | *MT-TS1 precursor* | *SNHL* |
| *A7445G* | *MT-CO1* | *SNHL* |
| *T7510C* | *MT-TS1* | *SNHL* |
| *T7511C* | *MT-TS1* | *SNHL/Deafness* |
| *A8344G* | *MT-TK* | *MERRF; Other-LD/Depressive mood disorder/ leukoencephalopathy/HiCM* |
| *T8356C* | *MT-TK* | *MERRF* |
| *T8528C* | *MT-ATP8/6* | *Infantile cardiomyopathy* |
| *T8851C* | *MT-ATP6* | *BSN/Leigh syndrome* |
| *T8993C* | *MT-ATP6* | *NARP/Leigh Disease/MILS/other* |
| *T9035C* | *MT-ATP6* | *Ataxia syndromes* |
| *A9155G* | *MT-ATP6* | *MIDD, renal insufficiency* |
| *T9176C* | *MT-ATP6* | *FBSN/Leigh Disease* |
| *T9185C* | *MT-ATP6* | *Leigh Disease/Ataxia syndromes/NARP-like disease* |
| *T10010C* | *MT-TG* | *PEM* |
| *T10158C* | *MT-ND3* | *Leigh Disease/MELAS* |
| *T10191C* | *MT-ND3* | *Leigh Disease/Leigh-like Disease/ESOC* |
| *T10663C* | *MT-ND4L* | *LHON* |
| *T12706C* | *MT-ND5* | *Leigh Disease* |
| *T13094C* | *MT-ND5* | *Ataxia + PEO/MELAS, LD, LHON, myoclonus, fatigue* |
| *A13514G* | *MT-ND5* | *Leigh Disease/MELAS/Ca2+ downregulation* |
| *T14484C* | *MT-ND6* | *LHON* |
| *T14487C* | *MT-ND6* | *Dystonia/Leigh Disease/ataxia/ptosis/epilepsy* |
| *A14495G* | *MT-ND6* | *LHON* |
| *T14674C* | *MT-TE* | *Reversible COX deficiency myopathy* |
| *T14709C* | *MT-TE* | *MM + DMDF/Encephalomyopathy/ Dementia + diabetes + ophthalmoplegia* |
| *T14849C* | *MT-CYB* | *EXIT/Septo-Optic Dysplasia* |
| *T14864C* | *MT-CYB* | *MELAS* |
| *A15579G* | *MT-CYB* | *Multisystem Disorder, EXIT* |
| G583A | MT-TF | MELAS/MM & EXIT |
| C1494T | MT-RNR1 | DEAF |
| G1606A | MT-TV | AMDF |
| G1644A | MT-TV | LS/HCM/MELAS |
| C3256T | MT-TL1 | MELAS; possible atherosclerosis risk |
| C3303T | MT-TL1 | MMC |
| G3376A | MT-ND1 | LHON MELAS overlap |
| G3460A | MT-ND1 | LHON |
| G3635A | MT-ND1 | LHON |
| G3697A | MT-ND1 | MELAS/LS/LDYT/BSN |
| G3700A | MT-ND1 | LHON |
| G3733A | MT-ND1 | LHON |
| G3890A | MT-ND1 | Progressive Encephalomyopathy/LS/Optic Atrophy |
| G4298A | MT-TI | CPEO/MS |
| G4308A | MT-TI | CPEO |
| G4332A | MT-TQ | Encephalopathy/MELAS |
| G4450A | MT-TM | Myopathy/MELAS |
| G5521A | MT-TW | Mitochondrial myopathy |
| G5650A | MT-TA | Myopathy |
| G5703A | MT-TN | CPEO/MM |
| G7497A | MT-TS1 | MM/EXIT |
| G8340A | MT-TK | Myopathy/Exercise Intolerance/Eye disease + SNHL |

TABLE 7-continued

Disease-associated mitochondrial DNA point mutations. Pathogenic mtDNA point mutations were obtained from the MITOMAP database12 (accessed Dec. 10, 2019). Disease-associated mutations in rRNA/tRNA and coding/non-coding regions were considered only if they had been assigned 'Cfrm' statuses. Italics: SNPs that are corrected by C•G-to-T•A conversions; Underlined: SNPs that are corrected by A•T-to-G•C conversions; Bold, underlined: SNPs that are corrected by A•T-to-C•G conversions; Bold, italics: SNPs that are corrected by C•G-to-G•C conversions; Italics, underlined: SNPs that are corrected by A•T-to-T•A conversions

| Allele SNP | Locus | Associated disease |
|---|---|---|
| G8363A | MT-TK | MICM + DEAF/MERRF/Autism/LS/Ataxia + Lipomas |
| G8969A | MT-ATP6 | Mitochondrial myopathy, lactic acidosis and sideroblastic anemia (MLASA)/IgG nephropathy |
| G10197A | MT-ND3 | Leigh Disease/Dystonia/Stroke/LDYT |
| G11778A | MT-ND4 | LHON/Progressive Dystonia |
| G12147A | MT-TH | MERRF-MELAS/Encephalopathy |
| G12276A | MT-TL2 | CPEO |
| G12294A | MT-TL2 | CPEO/EXIT + Ophthalmoplegia |
| G12315A | MT-TL2 | CPEO/KSS/possible carotid atherosclerosis risk, trend toward myocardial infarction risk |
| G12316A | MT-TL2 | CPEO |
| G13042A | MT-ND5 | Optic neuropathy/retinopathy/LD |
| G13051A | MT-ND5 | LHON |
| G13513A | MT-ND5 | Leigh Disease/MELAS/LHON-MELAS Overlap Syndrome/ negative association w Carotid Atherosclerosis |
| G14459A | MT-ND6 | LDYT/Leigh Disease/dystonia/carotid atherosclerosis risk |
| G14710A | MT-TE | Encephalomyopathy + Retinopathy |
| **C4171A** | **MT-ND1** | **LHON/Leigh-like phenotype** |
| **C11777A** | **MT-ND4** | **Leigh Disease** |
| **C12258A** | **MT-TS2** | **DMDF/RP + SNHL** |
| **C14482A** | **MT-ND6** | **LHON** |
| ***C14482G*** | ***MT-ND6*** | ***LHON*** |
| *A3243T* | *MT-TL1* | *MM/MELAS/SNHL/CPEO* |

Tables 8A-8B|List of Bacterial Strains and Plasmids Used in Example 1

Table 8A is a list of bacterial strains used in this study.

| Bacterial species and strains | Genotype | Purpose | Source |
|---|---|---|---|
| *Escherichia coli* DH5α | F- φ80lacZΔM15 Δ(lacZYA-argF)U169 recA1 endA1 hsdR17(rK–, mK+) phoA supE44 λ-thi-1 gyrA96 relA1 | General cloning | Thermo Fisher Scientific Cat#18258012 |
| *Escherichia coli* DH5α:Dddl | F- φ80lacZΔM15 Δ(lacZYA-argF)U169 recA1 endA1 hsdR17(rK–, mK+) phoA supE44 A-thi-1 gyrA96 relA1, with chromosomally integrated dddl | Cloning for full-length $DddA_{tox}$ fusions | This study |
| *Escherichia coli* Mach1 | str. W ΔrecA1398 endA1 fhuA φ80Δ(lac)M 15 Δ(lac)X74 hsdR($r_K^-$ $m_K^+$) | General cloning (mammalian plasmids) | Thermo Fisher Scientific Cat# C862003 |
| *Escherichia coli* BL21 | $F^-$ ompT $hsdS_B$ ($r_B^-$, $m_B^-$) gal dcm (DE3) | Protein extraction | EMD Millipore Cat#69450 |
| *Escherichia coli* XK1502 | F– ΔlacU169 nalA | Protein expression | PMID: 16923902 |
| *Burkholderia cenocepacia* H111 | Wild type | Amplification of dddA-$dddA_I$, parental strain for mutant construction | PMID: 10713433 |
| *Burkholderia cenocepacia* H111 AicmF1 GentR | Δ I35_RS01770, attTn7::aacC1 | Growth competition assays | This study |
| *Burkholderia cenocepacia* H111 AicmF2 GentR | Δ I35_RS17395, attTn7::aacC1 | Growth competition assays | This study |
| *Burkholderia cenocepacia* H111 AdddAAdddAl GentR | ΔI35_RS34180Δ I35_RS34175, attTn7::aacC1 | Growth competition assays | This study |
| *Burkholderia cenocepacia* H111 dddAE1347A | I35_$RS34180^{E1347A}$, attTn7::aacC1 | Growth competition assays | This study |
| *Pseudomonas aeruginosa* PAO1 | Wild type | Growth competition assays | PMID: 10984043 |

Table 8B is a List of Plasmids Used in this Study.

| Plasmids | Purpose | Source |
|---|---|---|
| pPSV39-CV | For inducible expression of proteins in *E. coli* | PMID: 23954347 |
| pScrhaB2-V | For inducible expression of proteins in *E. coli* | PMID: 15925406 |
| pBAD24 | Protein expression | PMID: 7608087 |
| pETDuet-1 | Protein expression | EMD Millipore Cat#71146-3 |
| pDONRPEX18Gm-Scel-pheS | Allelic replacement in *B. cenocepacia* | PMID: 25795676 |
| pDAI-Scel-pheS | Allelic replacement in *B. cenocepacia* | PMID: 25795676 |
| pUC18T-mini-Tn7T-Gm | For the generation of gentamycin resistant *B. cenocepacia* | PMID: 15908923 |
| pScrhaB2-V ::dddA | To express dddA | This study |
| pScrhaB2-V ::cdd | To express cdd | This study |
| pScrhaB2-V::APOBEC3G | To express APOBEC3G | This study |
| pScrhaB2-V::tadA | To express tadA | This study |
| pPSV39-CV::dddA$_I$ | To express dddAl | This study |
| pDONRPEX18Gm-Scel-pheS::ΔicmF1 | To delete icmF1 from *B. cenocepacia* | This study |
| pDONRPEX18Gm-Scel-pheS::ΔicmF2 | To delete icmF2 from *B. cenocepacia* | This study |
| pDONRPEX18Gm-Scel-pheS::ΔdddAΔdddA$_I$ | To delete dddA and dddA$_I$ from *B. cenocepacia* | This study |
| pDONRPEX18Gm-Scel-pheS::dddA$^{E1347A}$ | To generate the dddAE$^{1347A}$ catalytic mutant in *B. cenocepacia* | This study |
| pBAD24::ung | To express ung in *E. coli* | This study |
| pETDuet-1 mcs1::dddA-his$_6$ mcs1::dddA$_I$ | To co-express dddA-dddA$_I$ | This study |
| pTNS3 | Tn7 transposase expression | PMID: 18156318 |
| pRK2013 | Helper plasmid for plasmid mobilization | ATCC ® 37159 |
| pKD46 | Recombinase expression plasmid for A Red deletion system | PMID: 10829079 |
| pKD4 | Template for ung deletion amplicon | PMID: 10829079 |
| pCMV | For mammalian expression of BE2, BE4max, split DddAtox and all DddAtox fusions | PMID: 27096365 PMID: 24531420 for CCR5 TALEs |

TABLE 9A

| shows gRNA sequences for Cas9 screening | | |
|---|---|---|
| gRNA | Sequence (5'-to-3') | SEQ ID NO: |
| spG7 | CCACTGGGGCCTCAACACTC | 332 |
| spG6 | GAGGCCCCCAGAGCAGCCAC | 333 |
| saG1 | TCTGTGCCCCTCCCTCCCTGGC | 334 |
| saG2 | GCCCCTCCCTCCCTGGCCCAGGT | 335 |
| saG3 | CCCTCCCTGGCCCAGGTGAAGG | 336 |
| saG4 | GTGTGGTTCCAGAACCGGAGGA | 337 |

| | dsDNA spacing length (bp) | | | |
|---|---|---|---|---|
| | saG1 | saG2 | saG3 | saG4 |
| spG7 | 28 | 33 | 39 | 60 |
| spG6 | 12 | 17 | 23 | 44 |

TABLE 10A

| KKH-Cas9 half with saG4 gRNA | | | | | | | | | | | | | |
|---|---|---|---|---|---|---|---|---|---|---|---|---|---|
| Batch | Nucleotide | G | G | C | C | C | C | T | A | A | C | C | C |
| G1333 DddAtox-N-SaKKH-Cas9 with saG4 gRNA | A | 0.19% | 0.03% | 0.00% | 0.00% | 0.00% | 0.00% | 0.00% | 99.92% | 99.68% | 0.00% | 0.00% | 0.01% |
| G1333 DddAtox-N-SaKKH-Cas9 with saG4 gRNA | T | 0.24% | 0.03% | 0.01% | 0.00% | 0.01% | 0.01% | 99.95% | 0.01% | 0.01% | 0.00% | 0.01% | 0.00% |
| G1333 DddAtox-N-SaKKH-Cas9 with saG4 gRNA | C | 0.13% | 0.03% | 99.28% | 99.98% | 99.97% | 99.97% | 0.03% | 0.05% | 0.00% | 99.98% | 99.98% | 99.79% |
| G1333 DddAtox-N-SaKKH-Cas9 with saG4 gRNA | G | 99.44% | 99.91% | 0.70% | 0.01% | 0.00% | 0.00% | 0.00% | 0.02% | 0.01% | 0.00% | 0.00% | 0.00% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.01% | 0.01% | 0.03% | 0.00% | 0.30% | 0.01% | 0.01% | 0.20% |
| G1333 DddAtox-C-SaKKH-Cas9 with saG4 gRNA | A | 0.19% | 0.04% | 0.00% | 0.00% | 0.00% | 0.00% | 0.00% | 99.93% | 99.63% | 0.00% | 0.00% | 0.00% |
| G1333 DddAtox-C-SaKKH-Cas9 with saG4 gRNA | T | 0.21% | 0.03% | 0.01% | 0.01% | 0.01% | 0.01% | 99.92% | 0.01% | 0.00% | 0.01% | 0.01% | 0.00% |
| G1333 DddAtox-C-SaKKH-Cas9 with saG4 gRNA | C | 0.13% | 0.02% | 99.27% | 99.98% | 99.97% | 99.97% | 0.03% | 0.04% | 0.01% | 99.99% | 99.98% | 99.73% |
| G1333 DddAtox-C-SaKKH-Cas9 with saG4 gRNA | G | 99.47% | 99.91% | 0.72% | 0.01% | 0.00% | 0.00% | 0.00% | 0.02% | 0.01% | 0.00% | 0.00% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.01% | 0.01% | 0.04% | 0.00% | 0.35% | 0.00% | 0.01% | 0.26% |
| G1397 DddAtox-N-SaKKH-Cas9 with saG4 gRNA | A | 0.21% | 0.04% | 0.01% | 0.01% | 0.00% | 0.01% | 0.00% | 99.93% | 99.62% | 0.01% | 0.00% | 0.01% |
| G1397 DddAtox-N-SaKKH-Cas9 with saG4 gRNA | T | 0.23% | 0.03% | 0.00% | 0.01% | 0.01% | 0.01% | 99.94% | 0.02% | 0.01% | 0.00% | 0.01% | 0.00% |
| G1397 DddAtox-N-SaKKH-Cas9 with saG4 gRNA | C | 0.13% | 0.03% | 99.26% | 99.97% | 99.98% | 99.98% | 0.02% | 0.03% | 0.00% | 99.98% | 99.99% | 99.75% |
| G1397 DddAtox-N-SaKKH-Cas9 with saG4 gRNA | G | 99.43% | 99.91% | 0.73% | 0.01% | 0.00% | 0.00% | 0.00% | 0.01% | 0.01% | 0.00% | 0.00% | 0.00% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.01% | 0.01% | 0.03% | 0.01% | 0.36% | 0.01% | 0.01% | 0.23% |
| G1397 DddAtox-C-SaKKH-Cas9 with saG4 gRNA | A | 0.19% | 0.03% | 0.01% | 0.01% | 0.00% | 0.01% | 0.00% | 99.91% | 99.63% | 0.00% | 0.01% | 0.01% |
| G1397 DddAtox-C-SaKKH-Cas9 with saG4 gRNA | T | 0.25% | 0.05% | 0.01% | 0.01% | 0.01% | 0.01% | 99.92% | 0.01% | 0.00% | 0.01% | 0.01% | 0.01% |
| G1397 DddAtox-C-SaKKH-Cas9 with saG4 gRNA | C | 0.16% | 0.01% | 99.19% | 99.97% | 99.98% | 99.97% | 0.03% | 0.04% | 0.01% | 99.98% | 99.98% | 99.73% |
| G1397 DddAtox-C-SaKKH-Cas9 with saG4 gRNA | G | 99.40% | 99.91% | 0.79% | 0.02% | 0.00% | 0.00% | 0.01% | 0.02% | 0.01% | 0.00% | 0.00% | 0.00% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.01% | 0.01% | 0.04% | 0.01% | 0.35% | 0.01% | 0.01% | 0.26% |

| Batch | Nucleotide | T | A | T | G | T | A | G | C | C | T | C | A |
|---|---|---|---|---|---|---|---|---|---|---|---|---|---|
| G1333 DddAtox-N-SaKKH-Cas9 with saG4 gRNA | A | 0.00% | 99.90% | 0.00% | 0.05% | 0.01% | 99.94% | 0.03% | 0.00% | 0.00% | 0.01% | 0.01% | 99.96% |
| G1333 DddAtox-N-SaKKH-Cas9 with saG4 gRNA | T | 99.97% | 0.01% | 99.98% | 0.03% | 99.97% | 0.01% | 0.04% | 0.01% | 0.01% | 99.98% | 0.01% | 0.00% |
| G1333 DddAtox-N-SaKKH-Cas9 with saG4 gRNA | C | 0.01% | 0.03% | 0.01% | 0.00% | 0.01% | 0.02% | 0.00% | 99.99% | 99.99% | 0.01% | 99.97% | 0.02% |
| G1333 DddAtox-N-SaKKH-Cas9 with saG4 gRNA | G | 0.00% | 0.02% | 0.00% | 99.92% | 0.00% | 0.03% | 99.93% | 0.00% | 0.00% | 0.00% | 0.00% | 0.01% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |

TABLE 10A-continued

| KKH-Cas9 half with saG4 gRNA | | | | | | | | | | | | | |
|---|---|---|---|---|---|---|---|---|---|---|---|---|---|
| G1333 DddAtox-N-SaKKH-Cas9 with saG4 gRNA | — | 0.02% | 0.04% | 0.01% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | A | 0.01% | 99.90% | 0.01% | 0.05% | 0.01% | 99.94% | 0.01% | 0.01% | 0.00% | 0.01% | 0.01% | 99.96% |
| G1333 DddAtox-C-SaKKH-Cas9 with saG4 gRNA | T | 99.97% | 0.02% | 99.97% | 0.03% | 99.98% | 0.00% | 0.05% | 0.01% | 0.01% | 99.99% | 0.02% | 0.01% |
| G1333 DddAtox-C-SaKKH-Cas9 with saG4 gRNA | C | 0.00% | 0.01% | 0.01% | 0.00% | 0.01% | 0.02% | 0.00% | 99.99% | 99.99% | 0.01% | 99.97% | 0.01% |
| G1333 DddAtox-C-SaKKH-Cas9 with saG4 gRNA | G | 0.00% | 0.03% | 0.00% | 99.92% | 0.00% | 0.04% | 99.94% | 0.00% | 0.00% | 0.00% | 0.00% | 0.02% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.02% | 0.04% | 0.01% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | A | 0.01% | 99.90% | 0.01% | 0.06% | 0.02% | 99.94% | 0.02% | 0.00% | 0.01% | 0.01% | 0.01% | 99.97% |
| G1397 DddAtox-N-SaKKH-Cas9 with saG4 gRNA | T | 99.95% | 0.01% | 99.97% | 0.04% | 99.97% | 0.01% | 0.03% | 0.00% | 0.01% | 99.97% | 0.01% | 0.01% |
| G1397 DddAtox-N-SaKKH-Cas9 with saG4 gRNA | C | 0.01% | 0.02% | 0.01% | 0.01% | 0.00% | 0.02% | 0.00% | 99.99% | 99.98% | 0.02% | 99.98% | 0.01% |
| G1397 DddAtox-N-SaKKH-Cas9 with saG4 gRNA | G | 0.00% | 0.01% | 0.00% | 99.90% | 0.00% | 0.03% | 99.95% | 0.00% | 0.00% | 0.01% | 0.00% | 0.02% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.03% | 0.06% | 0.01% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | A | 0.01% | 99.90% | 0.01% | 0.07% | 0.01% | 99.94% | 0.02% | 0.01% | 0.01% | 0.01% | 0.01% | 99.97% |
| G1397 DddAtox-C-SaKKH-Cas9 with saG4 gRNA | T | 99.95% | 0.01% | 99.96% | 0.04% | 99.97% | 0.01% | 0.05% | 0.01% | 0.01% | 99.97% | 0.02% | 0.00% |
| G1397 DddAtox-C-SaKKH-Cas9 with saG4 gRNA | C | 0.01% | 0.03% | 0.01% | 0.00% | 0.01% | 0.03% | 0.00% | 99.99% | 99.99% | 0.01% | 99.97% | 0.02% |
| G1397 DddAtox-C-SaKKH-Cas9 with saG4 gRNA | G | 0.00% | 0.03% | 0.00% | 99.89% | 0.00% | 0.03% | 99.93% | 0.00% | 0.00% | 0.01% | 0.00% | 0.01% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.03% | 0.03% | 0.02% | 0.00% | 0.00% | 0.00% | 0.00% | 0.00% | 0.00% | 0.00% | 0.00% | 0.00% |

| Batch | Nucle-otide | G | T | C | T | T | C | C | C | A | T | C | A | G |
|---|---|---|---|---|---|---|---|---|---|---|---|---|---|---|
| G1333 DddAtox-N-SaKKH-Cas9 with saG4 gRNA | A | 0.01% | 0.00% | 0.00% | 0.00% | 0.00% | 0.01% | 0.01% | 0.00% | 99.96% | 0.01% | 0.01% | 99.96% | 0.01% |
| G1333 DddAtox-N-SaKKH-Cas9 with saG4 gRNA | T | 0.05% | 99.99% | 0.00% | 99.98% | 99.97% | 0.01% | 0.00% | 0.01% | 0.01% | 99.98% | 0.01% | 0.01% | 0.04% |
| G1333 DddAtox-N-SaKKH-Cas9 with saG4 gRNA | C | 0.00% | 0.01% | 99.99% | 0.01% | 0.02% | 99.98% | 99.98% | 99.98% | 0.01% | 0.00% | 99.99% | 0.01% | 0.00% |

TABLE 10A-continued

| KKH-Cas9 half with saG4 gRNA | | | | | | | | | | | | | | |
|---|---|---|---|---|---|---|---|---|---|---|---|---|---|---|
| G1333 DddAtox-N-SaKKH-Cas9 with saG4 gRNA | G | 99.95% | 0.00% | 0.00% | 0.00% | 0.00% | 0.00% | 0.00% | 0.00% | 0.02% | 0.01% | 0.00% | 0.02% | 99.95% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | A | 0.01% | 0.01% | 0.00% | 0.00% | 0.01% | 0.00% | 0.01% | 0.01% | 99.96% | 0.00% | 0.01% | 99.96% | 0.01% |
| G1333 DddAtox-C-SaKKH-Cas9 with saG4 gRNA | T | 0.03% | 99.98% | 0.01% | 99.98% | 99.98% | 0.02% | 0.00% | 0.01% | 0.01% | 99.99% | 0.00% | 0.01% | 0.05% |
| G1333 DddAtox-C-SaKKH-Cas9 with saG4 gRNA | C | 0.00% | 0.01% | 99.99% | 0.02% | 0.01% | 99.98% | 99.99% | 99.98% | 0.01% | 0.00% | 99.98% | 0.01% | 0.00% |
| G1333 DddAtox-C-SaKKH-Cas9 with saG4 gRNA | G | 99.95% | 0.00% | 0.00% | 0.00% | 0.01% | 0.00% | 0.00% | 0.00% | 0.03% | 0.00% | 0.00% | 0.02% | 99.94% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | A | 0.01% | 0.00% | 0.01% | 0.00% | 0.00% | 0.01% | 0.00% | 0.00% | 99.95% | 0.00% | 0.00% | 99.96% | 0.01% |
| G1397 DddAtox-N-SaKKH-Cas9 with saG4 gRNA | T | 0.04% | 99.99% | 0.00% | 99.98% | 99.97% | 0.01% | 0.01% | 0.01% | 0.00% | 99.99% | 0.01% | 0.01% | 0.04% |
| G1397 DddAtox-N-SaKKH-Cas9 with saG4 gRNA | C | 0.01% | 0.01% | 99.99% | 0.01% | 0.02% | 99.98% | 99.98% | 99.98% | 0.01% | 0.01% | 99.99% | 0.01% | 0.00% |
| G1397 DddAtox-N-SaKKH-Cas9 with saG4 gRNA | G | 99.95% | 0.00% | 0.00% | 0.00% | 0.00% | 0.01% | 0.00% | 0.00% | 0.04% | 0.00% | 0.00% | 0.02% | 99.94% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% | 0.00% |

TABLE 10A-continued

| KKH-Cas9 half with saG4 gRNA | | | | | | | | | | | | | | |
|---|---|---|---|---|---|---|---|---|---|---|---|---|---|---|
| G1397 DddAtox-C-SaKKH-Cas9 with saG4 gRNA | A | 0.00% | 0.01% | 0.00% | 0.01% | 0.01% | 0.00% | 0.01% | 0.01% | 99.96% | 0.01% | 0.00% | 99.97% | 0.01% |
| G1397 DddAtox-C-SaKKH-Cas9 with saG4 gRNA | T | 0.04% | 99.98% | 0.00% | 99.98% | 99.97% | 0.01% | 0.01% | 0.01% | 0.01% | 99.98% | 0.01% | 0.00% | 0.03% |
| G1397 DddAtox-C-SaKKH-Cas9 with saG4 gRNA | C | 0.00% | 0.01% | 99.99% | 0.02% | 0.02% | 99.98% | 99.98% | 99.98% | 0.01% | 0.01% | 99.98% | 0.01% | 0.00% |
| G1397 DddAtox-C-SaKKH-Cas9 with saG4 gRNA | G | 99.95% | 0.00% | 0.00% | 0.00% | 0.01% | 0.00% | 0.00% | 0.00% | 0.02% | 0.01% | 0.00% | 0.02% | 99.96% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% | 0.00% |

| Batch | Nucle-otide | G | C | T | C | T | C | A | G | C | T | C |
|---|---|---|---|---|---|---|---|---|---|---|---|---|
| G1333 DddAtox-N-SaKKH-Cas9 with saG4 gRNA | A | 0.01% | 0.00% | 0.00% | 0.01% | 0.00% | 0.00% | 99.97% | 0.01% | 0.00% | 0.01% | 0.01% |
| G1333 DddAtox-N-SaKKH-Cas9 with saG4 gRNA | T | 0.03% | 0.00% | 99.99% | 0.01% | 99.99% | 0.01% | 0.00% | 0.01% | 0.01% | 99.98% | 0.01% |
| G1333 DddAtox-N-SaKKH-Cas9 with saG4 gRNA | C | 0.00% | 100.00% | 0.01% | 99.98% | 0.01% | 99.98% | 0.01% | 0.00% | 99.99% | 0.01% | 99.98% |
| G1333 DddAtox-N-SaKKH-Cas9 with saG4 gRNA | G | 99.96% | 0.00% | 0.00% | 0.00% | 0.00% | 0.00% | 0.02% | 99.97% | 0.00% | 0.00% | 0.00% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | A | 0.01% | 0.00% | 0.00% | 0.01% | 0.00% | 0.01% | 99.97% | 0.00% | 0.00% | 0.01% | 0.00% |
| G1333 DddAtox-C-SaKKH-Cas9 with saG4 gRNA | T | 0.02% | 0.01% | 99.99% | 0.01% | 99.98% | 0.02% | 0.00% | 0.01% | 0.01% | 99.97% | 0.01% |

TABLE 10A-continued

| KKH-Cas9 half with saG4 gRNA | | | | | | | | | | | | |
|---|---|---|---|---|---|---|---|---|---|---|---|---|
| G1333 DddAtox-C-SaKKH-Cas9 with saG4 gRNA | C | 0.00% | 99.98% | 0.00% | 99.99% | 0.01% | 99.98% | 0.01% | 0.00% | 99.99% | 0.02% | 99.98% |
| G1333 DddAtox-C-SaKKH-Cas9 with saG4 gRNA | G | 99.97 | 0.00% | 0.00% | 0.00% | 0.00% | 0.00% | 0.022% | 99.98% | 0.00% | 0.00% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | A | 0.01% | 0.00% | 0.00% | 0.00% | 0.00% | 0.00% | 99.98% | 0.01% | 0.00% | 0.00% | 0.00% |
| G1397 DddAtox-N-SaKKH-Cas9 with saG4 gRNA | T | 0.01% | 0.00% | 99.99% | 0.01% | 99.99% | 0.01% | 0.00% | 0.01% | 0.01% | 99.98% | 0.01% |
| G1397 DddAtox-N-SaKKH-Cas9 with saG4 gRNA | C | 0.01% | 99.99% | 0.01% | 99.99% | 0.01% | 99.98% | 0.01% | 0.00% | 99.98% | 0.01% | 99.98% |
| G1397 DddAtox-N-SaKKH-Cas9 with saG4 gRNA | G | 99.97% | 0.00% | 0.00% | 0.00% | 0.00% | 0.00% | 0.01% | 99.98% | 0.00% | 0.01% | 0.00% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | A | 0.01% | 0.00% | 0.00% | 0.00% | 0.01% | 0.01% | 99.96% | 0.01% | 0.00% | 0.01% | 0.00% |
| G1397 DddAtox-C-SaKKH-Cas9 with saG4 gRNA | T | 0.01% | 0.00% | 99.98% | 0.00% | 99.98% | 0.01% | 0.00% | 0.01% | 0.01% | 99.97% | 0.01% |
| G1397 DddAtox-C-SaKKH-Cas9 with saG4 gRNA | C | 0.01% | 99.99% | 0.02% | 100.00% | 0.01% | 99.98% | 0.01% | 0.00% | 99.98% | 0.01% | 99.98% |
| G1397 DddAtox-C-SaKKH-Cas9 with saG4 gRNA | G | 99.97% | 0.00% | 0.00% | 0.00% | 0.00% | 0.00% | 0.02% | 99.97% | 0.00% | 0.01% | 0.00% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% |

TABLE 10A-continued

| KKH-Cas9 half with saG4 gRNA | | | | | | | | | | | | |
|---|---|---|---|---|---|---|---|---|---|---|---|---|
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% |

| Batch | Nucle-otide | A | G | C | C | T | G | A | G | T | G | T | T |
|---|---|---|---|---|---|---|---|---|---|---|---|---|---|
| G1333 DddAtox-N-SaKKH-Cas9 with saG4 gRNA | A | 99.97% | 0.02% | 0.00% | 0.00% | 0.00% | 0.01% | 99.96% | 0.00% | 0.01% | 0.01% | 0.01% | 0.00% |
| G1333 DddAtox-N-SaKKH-Cas9 with saG4 gRNA | T | 0.00% | 0.01% | 0.01% | 0.01% | 99.98% | 0.02% | 0.00% | 0.01% | 99.96% | 0.01% | 99.97% | 99.97% |
| G1333 DddAtox-N-SaKKH-Cas9 with saG4 gRNA | C | 0.01% | 0.00% | 99.99% | 99.99% | 0.01% | 0.00% | 0.01% | 0.00% | 0.01% | 0.00% | 0.01% | 0.02% |
| G1333 DddAtox-N-SaKKH-Cas9 with saG4 gRNA | G | 0.02% | 99.97% | 0.00% | 0.00% | 0.00% | 99.97% | 0.02% | 99.98% | 0.02% | 99.97% | 0.01% | 0.01% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | A | 99.96% | 0.01% | 0.00% | 0.00% | 0.00% | 0.01% | 99.98% | 0.00% | 0.01% | 0.01% | 0.00% | 0.01% |
| G1333 DddAtox-C-SaKKH-Cas9 with saG4 gRNA | T | 0.00% | 0.01% | 0.01% | 0.00% | 99.98% | 0.01% | 0.00% | 0.01% | 99.96% | 0.01% | 99.96% | 99.97% |
| G1333 DddAtox-C-SaKKH-Cas9 with saG4 gRNA | C | 0.01% | 0.00% | 99.99% | 100.00% | 0.02% | 0.00% | 0.00% | 0.00% | 0.01% | 0.00% | 0.02% | 0.02% |
| G1333 DddAtox-C-SaKKH-Cas9 with saG4 gRNA | G | 0.03% | 99.98% | 0.00% | 0.00% | 0.00% | 99.99% | 0.02% | 99.99% | 0.02% | 99.98% | 0.01% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | A | 99.97% | 0.01% | 0.00% | 0.01% | 0.00% | 0.01% | 99.97% | 0.01% | 0.01% | 0.01% | 0.01% | 0.01% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-N-SaKKH-Cas9 with saG4 gRNA | T | 0.01% | 0.01% | 0.00% | 0.01% | 99.98% | 0.02% | 0.00% | 0.01% | 99.97% | 0.01% | 99.96% | 99.97% |
| G1397 DddAtox-N-SaKKH-Cas9 with saG4 gRNA | C | 0.01% | 0.00% | 100.00% | 99.99% | 0.01% | 0.00% | 0.01% | 0.00% | 0.01% | 0.00% | 0.02% | 0.01% |
| G1397 DddAtox-N-SaKKH-Cas9 with saG4 gRNA | G | 0.01% | 99.98% | 0.00% | 0.00% | 0.00% | 99.97% | 0.01% | 99.99% | 0.01% | 99.97% | 0.00% | 0.01% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | A | 99.97% | 0.01% | 0.00% | 0.00% | 0.01% | 0.01% | 99.97% | 0.01% | 0.01% | 0.00% | 0.01% | 0.00% |
| G1397 DddAtox-C-SaKKH-Cas9 with saG4 gRNA | T | 0.01% | 0.01% | 0.01% | 0.01% | 99.97% | 0.01% | 0.01% | 0.00% | 99.94% | 0.01% | 99.97% | 99.97% |
| G1397 DddAtox-C-SaKKH-Cas9 with saG4 gRNA | C | 0.01% | 0.00% | 99.99% | 99.99% | 0.02% | 0.01% | 0.01% | 0.00% | 0.02% | 0.01% | 0.02% | 0.02% |
| G1397 DddAtox-C-SaKKH-Cas9 with saG4 gRNA | G | 0.01% | 99.98% | 0.01% | 0.00% | 0.00% | 99.97% | 0.01% | 99.99% | 0.03% | 99.98% | 0.01% | 0.01% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucleotide | G | A | G | G | C | C | C | C | A | G | T | G |
|---|---|---|---|---|---|---|---|---|---|---|---|---|---|
| G1333 DddAtox-N-SaKKH-Cas9 with saG4 gRNA | A | 0.02% | 99.95% | 0.01% | 0.01% | 0.00% | 0.01% | 0.01% | 0.01% | 99.94% | 0.00% | 0.01% | 0.01% |
| G1333 DddAtox-N-SaKKH-Cas9 with saG4 gRNA | T | 0.01% | 0.01% | 0.01% | 0.01% | 0.01% | 0.00% | 0.01% | 0.01% | 0.01% | 0.01% | 99.96% | 0.00% |
| G1333 DddAtox-N-SaKKH-Cas9 with saG4 gRNA | C | 0.00% | 0.03% | 0.00% | 0.00% | 99.97% | 99.99% | 99.97% | 99.96% | 0.02% | 0.00% | 0.02% | 0.00% |

TABLE 10A-continued

| KKH-Cas9 half with saG4 gRNA | | | | | | | | | | | | | |
|---|---|---|---|---|---|---|---|---|---|---|---|---|---|
| G1333 DddAtox-N-SaKKH-Cas9 with saG4 gRNA | G | 99.95% | 0.01% | 99.96% | 99.97% | 0.00% | 0.00% | 0.00% | 0.00% | 0.03% | 99.98% | 0.01% | 99.98% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.01% | 0.01% | 0.01% | 0.00% | 0.00% | 0.00% | 0.00% | 0.02% | 0.00% | 0.00% | 0.00% | 0.00% |
| G1333 DddAtox-C-SaKKH-Cas9 with saG4 gRNA | A | 0.02% | 99.96% | 0.01% | 0.01% | 0.00% | 0.01% | 0.01% | 0.01% | 99.96% | 0.00% | 0.02% | 0.02% |
| G1333 DddAtox-C-SaKKH-Cas9 with saG4 gRNA | T | 0.01% | 0.01% | 0.02% | 0.01% | 0.00% | 0.01% | 0.01% | 0.01% | 0.01% | 0.01% | 99.94% | 0.02% |
| G1333 DddAtox-C-SaKKH-Cas9 with saG4 gRNA | C | 0.00% | 0.02% | 0.00% | 0.00% | 99.99% | 99.98% | 99.98% | 99.97% | 0.02% | 0.00% | 0.02% | 0.00% |
| G1333 DddAtox-C-SaKKH-Cas9 with saG4 gRNA | G | 99.96% | 0.01% | 99.97% | 99.97% | 0.00% | 0.00% | 0.00% | 0.00% | 0.02% | 99.99% | 0.02% | 99.96% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.00% | 0.00% | 0.00% | 0.01% | 0.00% | 0.00% | 0.00% | 0.00% |
| G1397 DddAtox-N-SaKKH-Cas9 with saG4 gRNA | A | 0.02% | 99.95% | 0.01% | 0.02% | 0.00% | 0.01% | 0.01% | 0.01% | 99.98% | 0.01% | 0.02% | 0.01% |
| G1397 DddAtox-N-SaKKH-Cas9 with saG4 gRNA | T | 0.01% | 0.00% | 0.02% | 0.00% | 0.01% | 0.01% | 0.01% | 0.02% | 0.00% | 0.01% | 99.93% | 0.01% |
| G1397 DddAtox-N-SaKKH-Cas9 with saG4 gRNA | C | 0.00% | 0.02% | 0.00% | 0.00% | 99.97% | 99.98% | 99.98% | 99.95% | 0.00% | 0.00% | 0.02% | 0.00% |
| G1397 DddAtox-N-SaKKH-Cas9 with saG4 gRNA | G | 99.97% | 0.02% | 99.97% | 99.97% | 0.01% | 0.00% | 0.01% | 0.01% | 0.01% | 99.98% | 0.03% | 99.98% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.02% | 0.00% | 0.00% | 0.00% | 0.00% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1397 DddAtox-C-SaKKH-Cas9 with saG4 gRNA | A | 0.01% | 99.95% | 0.01% | 0.01% | 0.01% | 0.01% | 0.01% | 0.02% | 99.96% | 0.00% | 0.01% | 0.01% |
| G1397 DddAtox-C-SaKKH-Cas9 with saG4 gRNA | T | 0.00% | 0.01% | 0.01% | 0.01% | 0.01% | 0.01% | 0.00% | 0.00% | 0.00% | 0.01% | 99.95% | 0.01% |
| G1397 DddAtox-C-SaKKH-Cas9 with saG4 gRNA | C | 0.00% | 0.03% | 0.00% | 0.00% | 99.98% | 99.98% | 99.98% | 99.96% | 0.01% | 0.00% | 0.02% | 0.01% |
| G1397 DddAtox-C-SaKKH-Cas9 with saG4 gRNA | G | 99.98% | 0.01% | 99.97% | 99.99% | 0.00% | 0.01% | 0.00% | 0.00% | 0.02% | 99.98% | 0.02% | 99.97% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucleotide | G | C | T | G | C | T | C | T | G | G | G | G |
|---|---|---|---|---|---|---|---|---|---|---|---|---|---|
| G1333 DddAtox-N-SaKKH-Cas9 with saG4 gRNA | A | 0.00% | 0.01% | 0.01% | 0.02% | 0.01% | 0.00% | 0.01% | 0.01% | 0.01% | 0.01% | 0.01% | 0.01% |
| G1333 DddAtox-N-SaKKH-Cas9 with saG4 gRNA | T | 0.01% | 0.01% | 99.97% | 0.02% | 0.00% | 99.97% | 0.00% | 99.97% | 0.02% | 0.02% | 0.02% | 0.01% |
| G1333 DddAtox-N-SaKKH-Cas9 with saG4 gRNA | C | 0.00% | 99.98% | 0.02% | 0.00% | 99.99% | 0.01% | 99.99% | 0.02% | 0.01% | 0.00% | 0.01% | 0.01% |
| G1333 DddAtox-N-SaKKH-Cas9 with saG4 gRNA | G | 99.98% | 0.00% | 0.00% | 99.96% | 0.00% | 0.01% | 0.00% | 0.00% | 99.96% | 99.97% | 99.95% | 99.97% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.01% |
| G1333 DddAtox-C-SaKKH-Cas9 with saG4 gRNA | A | 0.01% | 0.01% | 0.01% | 0.01% | 0.01% | 0.00% | 0.01% | 0.01% | 0.01% | 0.02% | 0.01% | 0.01% |
| G1333 DddAtox-C-SaKKH-Cas9 with saG4 gRNA | T | 0.02% | 0.01% | 99.98% | 0.02% | 0.01% | 99.98% | 0.00% | 99.97% | 0.02% | 0.03% | 0.02% | 0.01% |
| G1333 DddAtox-C-SaKKH-Cas9 with saG4 gRNA | C | 0.00% | 99.98% | 0.01% | 0.00% | 99.98% | 0.02% | 99.98% | 0.02% | 0.00% | 0.00% | 0.01% | 0.00% |
| G1333 DddAtox-C-SaKKH-Cas9 with saG4 gRNA | G | 99.96% | 0.00% | 0.00% | 99.97% | 0.00% | 0.00% | 0.00% | 0.00% | 99.97% | 99.95% | 99.77% | 99.77% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.20% | 0.20% |
| G1397 DddAtox-N-SaKKH-Cas9 with saG4 gRNA | A | 0.00% | 0.01% | 0.03% | 0.02% | 0.03% | 0.02% | 0.01% | 0.00% | 0.01% | 0.03% | 0.03% | 0.02% |
| G1397 DddAtox-N-SaKKH-Cas9 with saG4 gRNA | T | 0.01% | 0.00% | 99.94% | 0.01% | 0.01% | 99.95% | 0.01% | 99.98% | 0.02% | 0.02% | 0.01% | 0.01% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1397 DddAtox-N-SaKKH-Cas9 with saG4 gRNA | C | 0.01% | 99.98% | 0.01% | 0.00% | 99.96% | 0.01% | 99.98% | 0.01% | 0.01% | 0.01% | 0.01% | 0.00% |
| G1397 DddAtox-N-SaKKH-Cas9 with saG4 gRNA | G | 99.98% | 0.01% | 0.01% | 99.96% | 0.00% | 0.01% | 0.00% | 0.01% | 99.96% | 99.95% | 99.34% | 97.81% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.60% | 2.15% |
| G1397 DddAtox-C-SaKKH-Cas9 with saG4 gRNA | A | 0.01% | 0.00% | 0.01% | 0.02% | 0.01% | 0.00% | 0.01% | 0.01% | 0.01% | 0.01% | 0.01% | 0.01% |
| G1397 DddAtox-C-SaKKH-Cas9 with saG4 gRNA | T | 0.02% | 0.01% | 99.97% | 0.02% | 0.01% | 99.99% | 0.01% | 99.96% | 0.02% | 0.02% | 0.02% | 0.01% |
| G1397 DddAtox-C-SaKKH-Cas9 with saG4 gRNA | C | 0.01% | 99.98% | 0.02% | 0.00% | 99.98% | 0.01% | 99.99% | 0.02% | 0.00% | 0.00% | 0.01% | 0.00% |
| G1397 DddAtox-C-SaKKH-Cas9 with saG4 gRNA | G | 99.97% | 0.00% | 0.00% | 99.96% | 0.00% | 0.01% | 0.00% | 0.00% | 99.97% | 99.97% | 99.96% | 99.97% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.01% |

| Batch | Nucle-otide | G | C | C | T | C | C | T | G | A | G | T | T |
|---|---|---|---|---|---|---|---|---|---|---|---|---|---|
| G1333 DddAtox-N-SaKKH-Cas9 with saG4 gRNA | A | 0.01% | 0.00% | 0.02% | 0.01% | 0.00% | 0.01% | 0.01% | 0.02% | 99.93% | 0.00% | 0.00% | 0.00% |
| G1333 DddAtox-N-SaKKH-Cas9 with saG4 gRNA | T | 0.02% | 0.00% | 0.00% | 99.97% | 0.00% | 0.01% | 99.96% | 0.02% | 0.00% | 0.00% | 99.97% | 99.97% |
| G1333 DddAtox-N-SaKKH-Cas9 with saG4 gRNA | C | 0.00% | 99.99% | 99.97% | 0.01% | 99.99% | 99.98% | 0.02% | 0.00% | 0.04% | 0.00% | 0.01% | 0.02% |
| G1333 DddAtox-N-SaKKH-Cas9 with saG4 gRNA | G | 99.95% | 0.00% | 0.00% | 0.00% | 0.00% | 0.00% | 0.00% | 99.95% | 0.02% | 99.98% | 0.01% | 0.00% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.02% | 0.00% | 0.01% | 0.01% | 0.01% | 0.01% | 0.01% | 0.00% | 0.00% | 0.00% | 0.00% | 0.00% |
| G1333 DddAtox-C-SaKKH-Cas9 with saG4 gRNA | A | 0.01% | 0.00% | 0.02% | 0.00% | 0.01% | 0.00% | 0.01% | 0.01% | 99.75% | 0.00% | 0.01% | 0.00% |
| G1333 DddAtox-C-SaKKH-Cas9 with saG4 gRNA | T | 0.01% | 0.01% | 0.01% | 99.77% | 0.01% | 0.00% | 99.77% | 0.01% | 0.01% | 0.01% | 99.77% | 99.78% |
| G1333 DddAtox-C-SaKKH-Cas9 with saG4 gRNA | C | 0.00% | 99.78% | 99.77% | 0.01% | 99.78% | 99.79% | 0.02% | 0.00% | 0.03% | 0.00% | 0.01% | 0.01% |
| G1333 DddAtox-C-SaKKH-Cas9 with saG4 gRNA | G | 99.74% | 0.00% | 0.00% | 0.00% | 0.00% | 0.00% | 0.00% | 99.77% | 0.01% | 99.79% | 0.01% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.24% | 0.20% | 0.20% | 0.20% | 0.20% | 0.20% | 0.21% | 0.20% | 0.20% | 0.20% | 0.20% | 0.20% |
| G1397 DddAtox-N-SaKKH-Cas9 with saG4 gRNA | A | 0.00% | 0.03% | 0.01% | 0.01% | 0.00% | 0.01% | 0.00% | 0.01% | 97.73% | 0.01% | 0.00% | 0.00% |
| G1397 DddAtox-N-SaKKH-Cas9 with saG4 gRNA | T | 0.01% | 0.01% | 0.01% | 97.80% | 0.01% | 0.01% | 97.82% | 0.01% | 0.01% | 0.01% | 97.75% | 97.76% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1397 DddAtox-N-SaKKH-Cas9 with saG4 gRNA | C | 0.01% | 97.81% | 97.80% | 0.01% | 97.84% | 97.83% | 0.02% | 0.00% | 0.03% | 0.00% | 0.03% | 0.01% |
| G1397 DddAtox-N-SaKKH-Cas9 with saG4 gRNA | G | 97.80% | 0.01% | 0.02% | 0.03% | 0.00% | 0.00% | 0.00% | 97.83% | 0.03% | 97.78% | 0.01% | 0.00% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 2.18% | 2.15% | 2.15% | 2.15% | 2.15% | 2.15% | 2.15% | 2.15% | 2.20% | 2.20% | 2.20% | 2.22% |
| G1397 DddAtox-C-SaKKH-Cas9 with saG4 gRNA | A | 0.01% | 0.00% | 0.01% | 0.01% | 0.00% | 0.00% | 0.01% | 0.01% | 99.93% | 0.01% | 0.01% | 0.00% |
| G1397 DddAtox-C-SaKKH-Cas9 with saG4 gRNA | T | 0.01% | 0.01% | 0.01% | 99.97% | 0.01% | 0.01% | 99.97% | 0.01% | 0.01% | 0.01% | 99.96% | 99.99% |
| G1397 DddAtox-C-SaKKH-Cas9 with saG4 gRNA | C | 0.01% | 99.98% | 99.98% | 0.01% | 99.98% | 99.99% | 0.01% | 0.00% | 0.03% | 0.00% | 0.01% | 0.01% |
| G1397 DddAtox-C-SaKKH-Cas9 with saG4 gRNA | G | 99.93% | 0.00% | 0.00% | 0.01% | 0.00% | 0.00% | 0.00% | 99.98% | 0.03% | 99.98% | 0.01% | 0.00% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.04% | 0.01% | 0.01% | 0.01% | 0.01% | 0.00% | 0.00% | 0.00% | 0.00% | 0.00% | 0.00% | 0.00% |

| Batch | Nucleotide | T | C | T | C | A | T | C | T | G | T | G | C |
|---|---|---|---|---|---|---|---|---|---|---|---|---|---|
| G1333 DddAtox-N-SaKKH-Cas9 with saG4 gRNA | A | 0.00% | 0.01% | 0.02% | 0.01% | 99.97% | 0.00% | 0.01% | 0.01% | 0.01% | 0.02% | 0.03% | 0.01% |
| G1333 DddAtox-N-SaKKH-Cas9 with saG4 gRNA | T | 99.98% | 0.01% | 99.96% | 0.01% | 0.00% | 99.99% | 0.00% | 99.97% | 0.02% | 99.93% | 0.01% | 0.00% |
| G1333 DddAtox-N-SaKKH-Cas9 with saG4 gRNA | C | 0.01% | 99.98% | 0.02% | 99.97% | 0.01% | 0.01% | 99.98% | 0.01% | 0.00% | 0.02% | 0.00% | 99.97% |
| G1333 DddAtox-N-SaKKH-Cas9 with saG4 gRNA | G | 0.00% | 0.00% | 0.00% | 0.00% | 0.01% | 0.00% | 0.00% | 0.00% | 99.96% | 0.01% | 99.95% | 0.00% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.01% | 0.01% | 0.01% | 0.01% | 0.01% |
| G1333 DddAtox-C-SaKKH-Cas9 with saG4 gRNA | A | 0.00% | 0.00% | 0.01% | 0.01% | 99.77% | 0.00% | 0.01% | 0.01% | 0.01% | 0.02% | 0.03% | 0.01% |
| G1333 DddAtox-C-SaKKH-Cas9 with saG4 gRNA | T | 99.78% | 0.00% | 99.77% | 0.01% | 0.00% | 99.79% | 0.01% | 99.78% | 0.02% | 99.73% | 0.02% | 0.01% |
| G1333 DddAtox-C-SaKKH-Cas9 with saG4 gRNA | C | 0.01% | 99.79% | 0.02% | 99.78% | 0.01% | 0.01% | 99.78% | 0.01% | 0.00% | 0.02% | 0.00% | 99.78% |
| G1333 DddAtox-C-SaKKH-Cas9 with saG4 gRNA | G | 0.00% | 0.00% | 0.00% | 0.00% | 0.02% | 0.00% | 0.00% | 0.00% | 99.77% | 0.02% | 99.74% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.20% | 0.20% | 0.20% | 0.20% | 0.20% | 0.20% | 0.20% | 0.20% | 0.20% | 0.20% | 0.21% | 0.21% |
| G1397 DddAtox-N-SaKKH-Cas9 with saG4 gRNA | A | 0.00% | 0.01% | 0.01% | 0.01% | 97.75% | 0.00% | 0.01% | 0.03% | 0.02% | 0.03% | 0.04% | 0.01% |
| G1397 DddAtox-N-SaKKH-Cas9 with saG4 gRNA | T | 97.76% | 0.01% | 97.75% | 0.01% | 0.01% | 97.42% | 0.01% | 96.67% | 0.01% | 96.65% | 0.01% | 0.02% |
| G1397 DddAtox-N-SaKKH-Cas9 with saG4 gRNA | C | 0.00% | 97.78% | 0.03% | 97.75% | 0.01% | 0.01% | 97.43% | 0.01% | 0.00% | 0.02% | 0.00% | 96.67% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1397 DddAtox-N-SaKKH-Cas9 with saG4 gRNA | G | 0.01% | 0.01% | 0.01% | 0.02% | 0.02% | 0.03% | 0.01% | 0.01% | 96.68% | 0.01% | 96.67% | 0.02% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 2.22% | 2.21% | 2.21% | 2.21% | 2.21% | 2.54% | 2.54% | 3.28% | 3.28% | 3.28% | 3.28% | 3.28% |
| G1397 DddAtox-C-SaKKH-Cas9 with saG4 gRNA | A | 0.00% | 0.01% | 0.01% | 0.00% | 99.97% | 0.00% | 0.01% | 0.01% | 0.01% | 0.03% | 0.02% | 0.00% |
| G1397 DddAtox-C-SaKKH-Cas9 with saG4 gRNA | T | 99.98% | 0.01% | 99.97% | 0.01% | 0.00% | 99.99% | 0.01% | 99.97% | 0.01% | 99.94% | 0.01% | 0.01% |
| G1397 DddAtox-C-SaKKH-Cas9 with saG4 gRNA | C | 0.01% | 99.98% | 0.01% | 99.98% | 0.01% | 0.00% | 99.98% | 0.01% | 0.00% | 0.02% | 0.00% | 99.98% |
| G1397 DddAtox-C-SaKKH-Cas9 with saG4 gRNA | G | 0.00% | 0.00% | 0.00% | 0.00% | 0.02% | 0.00% | 0.00% | 0.01% | 99.97% | 0.01% | 99.96% | 0.00% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| Batch | Nucleotide | C | C | C | T | C | C | C | T | C | C | C | T |
| G1333 DddAtox-N-SaKKH-Cas9 with saG4 gRNA | A | 0.00% | 0.02% | 0.02% | 0.01% | 0.01% | 0.01% | 0.02% | 0.01% | 0.00% | 0.02% | 0.02% | 0.01% |
| G1333 DddAtox-N-SaKKH-Cas9 with saG4 gRNA | T | 0.01% | 0.01% | 0.01% | 99.96% | 0.02% | 0.02% | 0.01% | 99.97% | 0.01% | 0.01% | 0.00% | 99.68% |
| G1333 DddAtox-N-SaKKH-Cas9 with saG4 gRNA | C | 99.98% | 99.96% | 99.95% | 0.02% | 99.96% | 99.96% | 99.95% | 0.01% | 99.96% | 99.94% | 99.95% | 0.02% |
| G1333 DddAtox-N-SaKKH-Cas9 with saG4 gRNA | G | 0.00% | 0.00% | 0.00% | 0.00% | 0.00% | 0.00% | 0.00% | 0.00% | 0.00% | 0.00% | 0.00% | 0.01% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.01% | 0.01% | 0.01% | 0.01% | 0.01% | 0.01% | 0.02% | 0.01% | 0.02% | 0.02% | 0.03% | 0.2% |
| G1333 DddAtox-C-SaKKH-Cas9 with saG4 gRNA | A | 0.00% | 0.01% | 0.01% | 0.01% | 0.01% | 0.01% | 0.02% | 0.01% | 0.01% | 0.01% | 0.01% | 0.01% |
| G1333 DddAtox-C-SaKKH-Cas9 with saG4 gRNA | T | 0.01% | 0.01% | 0.01% | 99.75% | 0.02% | 0.03% | 0.01% | 99.77% | 0.02% | 0.01% | 0.01% | 99.72% |
| G1333 DddAtox-C-SaKKH-Cas9 with saG4 gRNA | C | 99.78% | 99.78% | 99.77% | 0.02% | 99.76% | 99.76% | 99.76% | 0.01% | 99.74% | 99.75% | 99.76% | 0.03% |
| G1333 DddAtox-C-SaKKH-Cas9 with saG4 gRNA | G | 0.00% | 0.00% | 0.00% | 0.01% | 0.00% | 0.00% | 0.00% | 0.01% | 0.01% | 0.00% | 0.00% | 0.02% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.20% | 0.20% | 0.21% | 0.21% | 0.20% | 0.20% | 0.21% | 0.20% | 0.22% | 0.22% | 0.23% | 0.23% |
| G1397 DddAtox-N-SaKKH-Cas9 with saG4 gRNA | A | 0.03% | 0.02% | 0.02% | 0.01% | 0.01% | 0.01% | 0.01% | 0.01% | 0.01% | 0.01% | 0.02% | 0.01% |
| G1397 DddAtox-N-SaKKH-Cas9 with saG4 gRNA | T | 0.01% | 0.02% | 0.01% | 96.67% | 0.03% | 0.02% | 0.01% | 96.6% | 0.02% | 0.01% | 0.01% | 97.37% |
| G1397 DddAtox-N-SaKKH-Cas9 with saG4 gRNA | C | 96.68% | 96.65% | 96.67% | 0.02% | 96.68% | 96.67% | 96.68% | 0.01% | 96.65% | 97.40% | 97.40% | 0.03% |
| G1397 DddAtox-N-SaKKH-Cas9 with saG4 gRNA | G | 0.00% | 0.03% | 0.00% | 0.01% | 0.00% | 0.01% | 0.00% | 0.01% | 0.00% | 0.01% | 0.00% | 0.02% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 3.28% | 3.28% | 3.29% | 3.28% | 3.28% | 3.30% | 3.30% | 3.30% | 3.31% | 2.57% | 2.58% | 2.57% |
| G1397 DddAtox-C-SaKKH-Cas9 with saG4 gRNA | A | 0.01% | 0.01% | 0.01% | 0.01% | 0.01% | 0.03% | 0.01% | 0.00% | 0.01% | 0.03% | 0.02% | 0.01% |
| G1397 DddAtox-C-SaKKH-Cas9 with saG4 gRNA | T | 0.01% | 0.01% | 0.01% | 99.93% | 0.06% | 0.02% | 0.00% | 99.86% | 0.03% | 0.01% | 0.00% | 99.81% |
| G1397 DddAtox-C-SaKKH-Cas9 with saG4 gRNA | C | 99.98% | 99.98% | 99.97% | 0.05% | 99.93% | 99.94% | 99.98% | 0.12% | 99.94% | 99.83% | 99.84% | 0.03% |
| G1397 DddAtox-C-SaKKH-Cas9 with saG4 gRNA | G | 0.00% | 0.00% | 0.00% | 0.00% | 0.00% | 0.00% | 0.00% | 0.00% | 0.00% | 0.00% | 0.00% | 0.01% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.00% | 0.00% | 0.00% | 0.01% | 0.01% | 0.02% | 0.13% | 0.14% | 0.13% |

| Batch | Nucleotide | G | G | C | C | C | A | G | G | T | G | A | A |
|---|---|---|---|---|---|---|---|---|---|---|---|---|---|
| G1333 DddAtox-N-SaKKH-Cas9 with saG4 gRNA | A | 0.02% | 0.02% | 0.01% | 0.01% | 0.03% | 99.18% | 0.01% | 0.01% | 0.03% | 0.01% | 99.16% | 99.12% |
| G1333 DddAtox-N-SaKKH-Cas9 with saG4 gRNA | T | 0.01% | 0.01% | 0.04% | 0.01% | 0.01% | 0.01% | 0.01% | 0.01% | 98.88% | 0.01% | 0.01% | 0.01% |
| G1333 DddAtox-N-SaKKH-Cas9 with saG4 gRNA | C | 0.00% | 0.01% | 99.32% | 99.26% | 99.24% | 0.04% | 0.00% | 0.01% | 0.06% | 0.00% | 0.04% | 0.03% |
| G1333 DddAtox-N-SaKKH-Cas9 with saG4 gRNA | G | 99.53% | 99.52% | 0.01% | 0.00% | 0.01% | 0.06% | 99.26% | 99.26% | 0.28% | 99.22% | 0.04% | 0.08% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.44% | 0.44% | 0.62% | 0.71% | 0.72% | 0.72% | 0.72% | 0.72% | 0.75% | 0.76% | 0.76% | 0.76% |
| G1333 DddAtox-C-SaKKH-Cas9 with saG4 gRNA | A | 0.01% | 0.01% | 0.01% | 0.01% | 0.03% | 99.65% | 0.01% | 0.01% | 0.03% | 0.01% | 99.58% | 99.55% |
| G1333 DddAtox-C-SaKKH-Cas9 with saG4 gRNA | T | 0.01% | 0.02% | 0.01% | 0.01% | 0.02% | 0.01% | 0.01% | 0.01% | 99.30% | 0.01% | 0.01% | 0.01% |
| G1333 DddAtox-C-SaKKH-Cas9 with saG4 gRNA | C | 0.00% | 0.00% | 99.79% | 99.74% | 99.70% | 0.03% | 0.00% | 0.00% | 0.10% | 0.00% | 0.04% | 0.03% |
| G1333 DddAtox-C-SaKKH-Cas9 with saG4 gRNA | G | 99.78% | 99.77% | 0.01% | 0.00% | 0.00% | 0.06% | 99.73% | 99.70% | 0.29% | 99.69% | 0.05% | 0.08% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.20% | 0.20% | 0.19% | 0.24% | 0.24% | 0.24% | 0.25% | 0.27% | 0.29% | 0.29% | 0.32% | 0.32% |
| G1397 DddAtox-N-SaKKH-Cas9 with saG4 gRNA | A | 0.02% | 0.01% | 0.03% | 0.03% | 0.02% | 97.25% | 0.02% | 0.01% | 0.05% | 0.01% | 97.22% | 97.19% |
| G1397 DddAtox-N-SaKKH-Cas9 with saG4 gRNA | T | 0.01% | 0.01% | 0.05% | 0.01% | 0.01% | 0.02% | 0.02% | 0.01% | 96.78% | 0.01% | 0.02% | 0.02% |
| G1397 DddAtox-N-SaKKH-Cas9 with saG4 gRNA | C | 0.01% | 0.01% | 97.39% | 97.44% | 97.31% | 0.04% | 0.00% | 0.02% | 0.25% | 0.02% | 0.06% | 0.05% |
| G1397 DddAtox-N-SaKKH-Cas9 with saG4 gRNA | G | 97.42% | 97.43% | 0.02% | 0.01% | 0.02% | 0.06% | 97.30% | 97.29% | 0.29% | 97.31% | 0.04% | 0.09% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-N-SaKKH-Cas9 with saG4 gRNA | — | 2.54% | 2.54% | 2.50% | 2.51% | 2.64% | 2.64% | 2.67% | 2.67% | 2.63% | 2.65% | 2.65% | 2.66% |
| G1397 DddAtox-C-SaKKH-Cas9 with saG4 gRNA | A | 0.01% | 0.02% | 0.01% | 0.01% | 0.02% | 99.46% | 0.01% | 0.01% | 0.03% | 0.01% | 99.43% | 99.37% |
| G1397 DddAtox-C-SaKKH-Cas9 with saG4 gRNA | T | 0.01% | 0.01% | 0.02% | 0.01% | 0.02% | 0.01% | 0.02% | 0.01% | 99.18% | 0.01% | 0.01% | 0.01% |
| G1397 DddAtox-C-SaKKH-Cas9 with saG4 gRNA | C | 0.00% | 0.00% | 99.63% | 99.64% | 99.51% | 0.04% | 0.00% | 0.00% | 0.05% | 0.00% | 0.06% | 0.03% |
| G1397 DddAtox-C-SaKKH-Cas9 with saG4 gRNA | G | 99.86% | 99.86% | 0.01% | 0.01% | 0.00% | 0.05% | 99.52% | 99.53% | 0.29% | 99.51% | 0.04% | 0.09% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.11% | 0.11% | 0.33% | 0.34% | 0.44% | 0.44% | 0.45% | 0.45% | 0.46% | 0.46% | 0.47% | 0.50% |
| Batch | Nucleotide | G | G | T | G | T | G | G | T | T | C | C | A |
| G1333 DddAtox-N-SaKKH-Cas9 with saG4 gRNA | A | 0.00% | 0.01% | 0.04% | 0.01% | 0.03% | 0.02% | 0.00% | 0.01% | 0.00% | 0.01% | 0.02% | 99.10% |
| G1333 DddAtox-N-SaKKH-Cas9 with saG4 gRNA | T | 0.01% | 0.01% | 98.73% | 0.02% | 99.02% | 0.01% | 0.01% | 99.06% | 99.06% | 0.06% | 0.02% | 0.01% |
| G1333 DddAtox-N-SaKKH-Cas9 with saG4 gRNA | C | 0.00% | 0.00% | 0.05% | 0.00% | 0.03% | 0.00% | 0.00% | 0.02% | 0.01% | 99.00% | 99.01% | 0.01% |
| G1333 DddAtox-N-SaKKH-Cas9 with saG4 gRNA | G | 99.20% | 99.14% | 0.27% | 99.11% | 0.06% | 99.11% | 99.12% | 0.03% | 0.00% | 0.02% | 0.00% | 0.04% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.78% | 0.84% | 0.86% | 0.86% | 0.86% | 0.86% | 0.87% | 0.89% | 0.92% | 0.92% | 0.94% | 0.84% |
| G1333 DddAtox-C-SaKKH-Cas9 with saG4 gRNA | A | 0.01% | 0.00% | 0.03% | 0.01% | 0.02% | 0.01% | 0.01% | 0.01% | 0.01% | 0.00% | 0.02% | 99.50% |
| G1333 DddAtox-C-SaKKH-Cas9 with saG4 gRNA | T | 0.01% | 0.02% | 99.23% | 0.02% | 99.48% | 0.01% | 0.00% | 99.50% | 99.51% | 0.03% | 0.01% | 0.01% |
| G1333 DddAtox-C-SaKKH-Cas9 with saG4 gRNA | C | 0.00% | 0.00% | 0.06% | 0.01% | 0.02% | 0.01% | 0.00% | 0.03% | 0.02% | 99.51% | 99.51% | 0.01% |
| G1333 DddAtox-C-SaKKH-Cas9 with saG4 gRNA | G | 99.65% | 99.63% | 0.31% | 99.58% | 0.08% | 99.56% | 99.56% | 0.02% | 0.00% | 0.00% | 0.00% | 0.03% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.33% | 0.35% | 0.36% | 0.38% | 0.40% | 0.42% | 0.42% | 0.45% | 0.46% | 0.45% | 0.46% | 0.45% |
| G1397 DddAtox-N-SaKKH-Cas9 with saG4 gRNA | A | 0.01% | 0.01% | 0.04% | 0.01% | 0.01% | 0.02% | 0.03% | 0.02% | 0.01% | 0.00% | 0.02% | 96.50% |
| G1397 DddAtox-N-SaKKH-Cas9 with saG4 gRNA | T | 0.01% | 0.01% | 96.22% | 0.02% | 96.47% | 0.01% | 0.01% | 96.46% | 96.51% | 0.04% | 0.01% | 0.01% |
| G1397 DddAtox-N-SaKKH-Cas9 with saG4 gRNA | C | 0.01% | 0.02% | 0.07% | 0.01% | 0.03% | 0.00% | 0.01% | 0.05% | 0.02% | 96.51% | 96.50% | 0.01% |
| G1397 DddAtox-N-SaKKH-Cas9 with saG4 gRNA | G | 97.32% | 96.55% | 0.26% | 96.56% | 0.08% | 96.54% | 96.52% | 0.02% | 0.01% | 0.00% | 0.01% | 0.04% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 2.66% | 3.41% | 3.41% | 3.41% | 3.42% | 3.43% | 3.44% | 3.45% | 3.45% | 3.45% | 3.45% | 3.45% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-C-SaKKH-Cas9 with saG4 gRNA | A | 0.00% | 0.02% | 0.05% | 0.01% | 0.02% | 0.01% | 0.01% | 0.01% | 0.01% | 0.01% | 0.01% | 99.28% |
| G1397 DddAtox-C-SaKKH-Cas9 with saG4 gRNA | T | 0.02% | 0.03% | 99.08% | 0.01% | 99.32% | 0.02% | 0.01% | 99.32% | 99.34% | 0.03% | 0.02% | 0.01% |
| G1397 DddAtox-C-SaKKH-Cas9 with saG4 gRNA | C | 0.00% | 0.00% | 0.05% | 0.01% | 0.02% | 0.00% | 0.00% | 0.03% | 0.02% | 99.33% | 99.32% | 0.01% |
| G1397 DddAtox-C-SaKKH-Cas9 with saG4 gRNA | G | 99.47% | 99.42% | 0.27% | 99.42% | 0.06% | 99.38% | 99.40% | 0.02% | 0.01% | 0.01% | 0.00% | 0.05% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.51% | 0.53% | 0.56% | 0.56% | 0.58% | 0.59% | 0.58% | 0.61% | 0.63% | 0.63% | 0.64% | 0.65% |

| Batch | Nucleotide | G | A | A | C | C | G | G | A | G | G | A | C |
|---|---|---|---|---|---|---|---|---|---|---|---|---|---|
| G1333 DddAtox-N-SaKKH-Cas9 with saG4 gRNA | A | 0.01% | 99.11% | 99.11% | 0.01% | 0.01% | 0.02% | 0.01% | 98.94% | 0.01% | 0.01% | 99.12% | 0.00% |
| G1333 DddAtox-N-SaKKH-Cas9 with saG4 gRNA | T | 0.01% | 0.01% | 0.01% | 0.01% | 0.02% | 0.02% | 0.01% | 0.01% | 0.01% | 0.01% | 0.02% | 0.02% |
| G1333 DddAtox-N-SaKKH-Cas9 with saG4 gRNA | C | 0.00% | 0.02% | 0.02% | 99.02% | 99.00% | 0.00% | 0.00% | 0.02% | 0.00% | 0.01% | 0.04% | 99.28% |
| G1333 DddAtox-N-SaKKH-Cas9 with saG4 gRNA | G | 99.15% | 0.01% | 0.02% | 0.00% | 0.00% | 98.99% | 99.00% | 0.06% | 98.91% | 98.93% | 0.02% | 0.00% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.84% | 0.85% | 0.85% | 0.95% | 0.97% | 0.97% | 0.97% | 0.97% | 1.07% | 1.04% | 0.81% | 0.70% |
| G1333 DddAtox-C-SaKKH-Cas9 with saG4 gRNA | A | 0.01% | 99.50% | 99.50% | 0.00% | 0.00% | 0.02% | 0.01% | 99.41% | 0.01% | 0.01% | 99.60% | 0.01% |
| G1333 DddAtox-C-SaKKH-Cas9 with saG4 gRNA | T | 0.00% | 0.00% | 0.01% | 0.01% | 0.01% | 0.02% | 0.01% | 0.02% | 0.01% | 0.00% | 0.02% | 0.01% |
| G1333 DddAtox-C-SaKKH-Cas9 with saG4 gRNA | C | 0.00% | 0.02% | 0.02% | 99.52% | 99.50% | 0.00% | 0.00% | 0.02% | 0.00% | 0.00% | 0.05% | 99.75% |
| G1333 DddAtox-C-SaKKH-Cas9 with saG4 gRNA | G | 99.53% | 0.03% | 0.02% | 0.00% | 0.01% | 99.48% | 99.56% | 0.06% | 99.41% | 99.42% | 0.03% | 0.00% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.45% | 0.45% | 0.46% | 0.46% | 0.48% | 0.48% | 0.48% | 0.50% | 0.57% | 0.56% | 0.31% | 0.22% |
| G1397 DddAtox-N-SaKKH-Cas9 with saG4 gRNA | A | 0.01% | 96.51% | 96.49% | 0.02% | 0.02% | 0.02% | 0.01% | 96.43% | 0.01% | 0.01% | 98.49% | 0.01% |
| G1397 DddAtox-N-SaKKH-Cas9 with saG4 gRNA | T | 0.01% | 0.02% | 0.00% | 0.00% | 0.01% | 0.01% | 0.01% | 0.03% | 0.01% | 0.02% | 0.01% | 0.01% |
| G1397 DddAtox-N-SaKKH-Cas9 with saG4 gRNA | C | 0.00% | 0.01% | 0.03% | 96.51% | 96.51% | 0.00% | 0.00% | 0.03% | 0.00% | 0.01% | 0.09% | 98.65% |
| G1397 DddAtox-N-SaKKH-Cas9 with saG4 gRNA | G | 96.53% | 0.02% | 0.04% | 0.02% | 0.01% | 96.51% | 96.51% | 0.06% | 96.48% | 96.48% | 0.04% | 0.01% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 3.45% | 3.44% | 3.44% | 3.44% | 3.45% | 3.45% | 3.47% | 3.45% | 3.51% | 3.49% | 1.37% | 1.31% |
| G1397 DddAtox-C-SaKKH-Cas9 with saG4 gRNA | A | 0.01% | 99.28% | 99.25% | 0.01% | 0.01% | 0.01% | 0.02% | 99.31% | 0.01% | 0.01% | 99.37% | 0.01% |

TABLE 10A-continued

| | | | | | | | | | | | | | |
|---|---|---|---|---|---|---|---|---|---|---|---|---|---|
| KKH-Cas9 half with saG4 gRNA | | | | | | | | | | | | | |
| G1397 DddAtox-C-SaKKH-Cas9 with saG4 gRNA | T | 0.01% | 0.01% | 0.02% | 0.01% | 0.03% | 0.02% | 0.01% | 0.01% | 0.02% | 0.02% | 0.01% | 0.01% |
| G1397 DddAtox-C-SaKKH-Cas9 with saG4 gRNA | C | 0.01% | 0.02% | 0.04% | 99.30% | 99.26% | 0.00% | 0.00% | 0.03% | 0.00% | 0.01% | 0.05% | 99.60% |
| G1397 DddAtox-C-SaKKH-Cas9 with saG4 gRNA | G | 99.31% | 0.03% | 0.02% | 0.01% | 0.01% | 99.28% | 99.28% | 0.05% | 99.25% | 99.26% | 0.02% | 0.00% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.66% | 0.66% | 0.68% | 0.68% | 0.69% | 0.69% | 0.69% | 0.59% | 0.72% | 0.70% | 0.55% | 0.37% |
| Batch | Nucleotide | A | A | A | G | T | A | C | A | A | A | C | G |
| G1333 DddAtox-N-SaKKH-Cas9 with saG4 gRNA | A | 99.27% | 99.27% | 99.26% | 0.01% | 0.11 | 99.68% | 0.02% | 99.71% | 99.72% | 99.72% | 0.01% | 0.03% |
| G1333 DddAtox-N-SaKKH-Cas9 with saG4 gRNA | T | 0.01% | 0.02% | 0.00% | 0.01% | 99.27% | 0.00% | 0.02% | 0.00% | 0.00% | 0.00% | 0.02% | 0.00% |
| G1333 DddAtox-N-SaKKH-Cas9 with saG4 gRNA | C | 0.02% | 0.03% | 0.03% | 0.00% | 0.05% | 0.01% | 99.68% | 0.02% | 0.02% | 0.02% | 99.72% | 0.01% |
| G1333 DddAtox-N-SaKKH-Cas9 with saG4 gRNA | G | 0.03% | 0.01% | 0.03% | 99.41% | 0.07% | 0.02% | 0.00% | 0.01% | 0.01% | 0.01% | 0.01% | 99.96% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.68% | 0.68% | 0.67% | 0.57% | 0.50% | 0.28% | 0.27% | 0.26% | 0.25% | 0.25% | 0.25% | 0.00% |
| G1333 DddAtox-C-SaKKH-Cas9 with saG4 gRNA | A | 99.74% | 99.75% | 99.75% | 0.01% | 0.14% | 99.88% | 0.02% | 99.90% | 99.89% | 99.89% | 0.01% | 0.03% |
| G1333 DddAtox-C-SaKKH-Cas9 with saG4 gRNA | T | 0.01% | 0.01% | 0.01% | 0.00% | 99.63% | 0.02% | 0.00% | 0.00% | 0.00% | 0.00% | 0.02% | 0.01% |
| G1333 DddAtox-C-SaKKH-Cas9 with saG4 gRNA | C | 0.02% | 0.03% | 0.04% | 0.00% | 0.05% | 0.01% | 99.90% | 0.02% | 0.03% | 0.02% | 99.90% | 0.01% |
| G1333 DddAtox-C-SaKKH-Cas9 with saG4 gRNA | G | 0.02% | 0.01% | 0.05% | 99.84% | 0.07% | 0.01% | 0.00% | 0.01% | 0.01% | 0.02% | 0.01% | 99.91% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.21% | 0.21% | 0.15% | 0.14% | 0.12% | 0.08% | 0.07% | 0.07% | 0.06% | 0.07% | 0.07% | 0.05% |
| G1397 DddAtox-N-SaKKH-Cas9 with saG4 gRNA | A | 98.75% | 98.71% | 98.73% | 0.01% | 0.12% | 98.80% | 0.02% | 98.84% | 99.19% | 99.19% | 0.01% | 0.03% |
| G1397 DddAtox-N-SaKKH-Cas9 with saG4 gRNA | T | 0.02% | 0.03% | 0.00% | 0.02% | 98.44% | 0.02% | 0.01% | 0.00% | 0.02% | 0.01% | 0.05% | 0.01% |
| G1397 DddAtox-N-SaKKH-Cas9 with saG4 gRNA | C | 0.02% | 0.05% | 0.06% | 0.00% | 0.23% | 0.03% | 98.85% | 0.02% | 0.03% | 0.03% | 99.20% | 0.02% |
| G1397 DddAtox-N-SaKKH-Cas9 with saG4 gRNA | G | 0.03% | 0.03% | 0.04% | 98.80% | 0.06% | 0.03% | 0.00% | 0.04% | 0.01% | 0.03% | 0.00% | 99.20% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 1.17% | 1.17% | 1.16% | 1.16% | 1.15% | 1.12% | 1.11% | 1.10% | 0.75% | 0.75% | 0.74% | 0.74% |
| G1397 DddAtox-C-SaKKH-Cas9 with saG4 gRNA | A | 99.69% | 99.69% | 99.65% | 0.01% | 0.13% | 99.91% | 0.02% | 99.93% | 99.94% | 99.93% | 0.02% | 0.03% |
| G1397 DddAtox-C-SaKKH-Cas9 with saG4 gRNA | T | 0.01% | 0.01% | 0.01% | 0.01% | 99.66% | 0.01% | 0.01% | 0.00% | 0.00% | 0.00% | 0.02% | 0.01% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-C-SaKKH-Cas9 with saG4 gRNA | C | 0.02% | 0.03% | 0.04% | 0.00% | 0.05% | 0.02% | 99.92% | 0.02% | 0.03% | 0.03% | 99.93% | 0.00% |
| G1397 DddAtox-C-SaKKH-Cas9 with saG4 gRNA | G | 0.02% | 0.01% | 0.05% | 99.73% | 0.06% | 0.02% | 0.00% | 0.01% | 0.01% | 0.02% | 0.01% | 99.94% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.27% | 0.26% | 0.26% | 0.25% | 0.10% | 0.05% | 0.05% | 0.03% | 0.02% | 0.02% | 0.02% | 0.02% |

| Batch | Nucleotide | G | C | A | G | A | A | G | C | T | G | G | A |
|---|---|---|---|---|---|---|---|---|---|---|---|---|---|
| G1333 DddAtox-N-SaKKH-Cas9 with saG4 gRNA | A | 0.03% | 0.01% | 99.92% | 0.00% | 99.95% | 99.85% | 0.00% | 0.00% | 0.00% | 0.01% | 0.01% | 99.86% |
| G1333 DddAtox-N-SaKKH-Cas9 with saG4 gRNA | T | 0.01% | 0.01% | 0.01% | 0.01% | 0.00% | 0.00% | 0.01% | 0.01% | 99.95% | 0.02% | 0.02% | 0.01% |
| G1333 DddAtox-N-SaKKH-Cas9 with saG4 gRNA | C | 0.00% | 99.96% | 0.01% | 0.00% | 0.03% | 0.05% | 0.00% | 99.97% | 0.02% | 0.01% | 0.00% | 0.03% |
| G1333 DddAtox-N-SaKKH-Cas9 with saG4 gRNA | G | 99.96% | 0.01% | 0.06% | 99.99% | 0.02% | 0.09% | 99.98% | 0.01% | 0.02% | 99.97% | 99.97% | 0.10% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | A | 0.03% | 0.02% | 99.87% | 0.01% | 99.93% | 99.83% | 0.00% | 0.00% | 0.00% | 0.01% | 0.01% | 99.81% |
| G1333 DddAtox-C-SaKKH-Cas9 with saG4 gRNA | T | 0.00% | 0.01% | 0.01% | 0.00% | 0.01% | 0.00% | 0.00% | 0.01% | 99.92% | 0.01% | 0.01% | 0.02% |
| G1333 DddAtox-C-SaKKH-Cas9 with saG4 gRNA | C | 0.00% | 99.91% | 0.03% | 0.00% | 0.02% | 0.04% | 0.00% | 99.97% | 0.03% | 0.00% | 0.00% | 0.05% |
| G1333 DddAtox-C-SaKKH-Cas9 with saG4 gRNA | G | 99.92% | 0.01% | 0.05% | 99.94% | 0.01% | 0.11% | 99.97% | 0.00% | 0.03% | 99.96% | 99.95% | 0.11% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.05% | 0.05% | 0.05% | 0.05% | 0.02% | 0.02% | 0.02% | 0.02% | 0.02% | 0.02% | 0.02% | 0.02% |
| G1397 DddAtox-N-SaKKH-Cas9 with saG4 gRNA | A | 0.02% | 0.02% | 99.12% | 0.01% | 99.16% | 99.07% | 0.01% | 0.01% | 0.00% | 0.00% | 0.01% | 99.76% |
| G1397 DddAtox-N-SaKKH-Cas9 with saG4 gRNA | T | 0.01% | 0.02% | 0.03% | 0.03% | 0.03% | 0.02% | 0.01% | 0.02% | 99.95% | 0.02% | 0.02% | 0.02% |
| G1397 DddAtox-N-SaKKH-Cas9 with saG4 gRNA | C | 0.01% | 99.21% | 0.05% | 0.00% | 0.05% | 0.06% | 0.00% | 99.96% | 0.03% | 0.01% | 0.01% | 0.11% |
| G1397 DddAtox-N-SaKKH-Cas9 with saG4 gRNA | G | 99.21% | 0.01% | 0.07% | 99.23% | 0.02% | 0.11% | 99.24% | 0.01% | 0.02% | 99.97% | 99.95% | 0.11% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.74% | 0.74% | 0.73% | 0.73% | 0.73% | 0.74% | 0.73% | 0.00% | 0.00% | 0.00% | 0.00% | 0.00% |
| G1397 DddAtox-C-SaKKH-Cas9 with saG4 gRNA | A | 0.03% | 0.01% | 99.90% | 0.01% | 99.93% | 99.86% | 0.00% | 0.00% | 0.01% | 0.01% | 0.00% | 99.82% |
| G1397 DddAtox-C-SaKKH-Cas9 with saG4 gRNA | T | 0.01% | 0.01% | 0.01% | 0.01% | 0.01% | 0.01% | 0.01% | 0.01% | 99.93% | 0.01% | 0.02% | 0.01% |
| G1397 DddAtox-C-SaKKH-Cas9 with saG4 gRNA | C | 0.00% | 99.96% | 0.03% | 0.00% | 0.03% | 0.05% | 0.00% | 99.98% | 0.04% | 0.00% | 0.00% | 0.04% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-C-SaKKH-Cas9 with saG4 gRNA | G | 99.93% | 0.01% | 0.06% | 99.98% | 0.03% | 0.09% | 99.98% | 0.01% | 0.03% | 99.97% | 99.97% | 0.13% |
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.02% | 0.01% | 0.00% | 0.00% | 0.00% | 0.00% | 0.00% | 0.00% | 0.00% | 0.00% | 0.00% | 0.00% |
| Batch | Nucleotide | G | G | A | G | G | A | A | G | G | G | C | C |
| G1333 DddAtox-N-SaKKH-Cas9 with saG4 gRNA | A | 0.00% | 0.01% | 99.88% | 0.01% | 0.01% | 99.92% | 99.91% | 0.02% | 0.01% | 0.01% | 0.01% | 0.02% |
| G1333 DddAtox-N-SaKKH-Cas9 with saG4 gRNA | T | 0.02% | 0.02% | 0.01% | 0.02% | 0.01% | 0.01% | 0.01% | 0.01% | 0.01% | 0.02% | 0.04% | 0.08% |
| G1333 DddAtox-N-SaKKH-Cas9 with saG4 gRNA | C | 0.00% | 0.00% | 0.04% | 0.00% | 0.01% | 0.02% | 0.02% | 0.01% | 0.01% | 0.00% | 99.93% | 99.88% |
| G1333 DddAtox-N-SaKKH-Cas9 with saG4 gRNA | G | 99.97% | 99.97% | 0.07% | 99.97% | 99.97% | 0.06% | 0.06% | 99.97% | 99.97% | 99.97% | 0.02% | 0.01% |
| G1333 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.01% |
| G1333 DddAtox-C-SaKKH-Cas9 with saG4 gRNA | A | 0.01% | 0.01% | 99.85% | 0.00% | 0.02% | 99.90% | 99.87% | 0.01% | 0.00% | 0.00% | 0.02% | 0.02% |
| G1333 DddAtox-C-SaKKH-Cas9 with saG4 gRNA | T | 0.02% | 0.01% | 0.01% | 0.01% | 0.01% | 0.01% | 0.01% | 0.01% | 0.00% | 0.00% | 0.05% | 0.10% |
| G1333 DddAtox-C-SaKKH-Cas9 with saG4 gRNA | C | 0.00% | 0.00% | 0.02% | 0.00% | 0.00% | 0.02% | 0.02% | 0.01% | 0.00% | 0.01% | 99.90% | 99.85% |
| G1333 DddAtox-C-SaKKH-Cas9 with saG4 gRNA | G | 99.95% | 99.96% | 0.09% | 99.97% | 99.95% | 0.05% | 0.09% | 99.95% | 99.98% | 99.96% | 0.03% | 0.03% |
| G1333 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-SaKKH-Cas9 with saG4 gRNA | — | 0.02% | 0.02% | 0.02% | 0.02% | 0.02% | 0.02% | 0.02% | 0.02% | 0.02% | 0.02% | 0.00% | 0.00% |
| G1397 DddAtox-N-SaKKH-Cas9 with saG4 gRNA | A | 0.03% | 0.01% | 99.83% | 0.03% | 0.03% | 99.89% | 99.88% | 0.04% | 0.02% | 0.01% | 0.01% | 0.02% |
| G1397 DddAtox-N-SaKKH-Cas9 with saG4 gRNA | T | 0.02% | 0.01% | 0.03% | 0.00% | 0.01% | 0.02% | 0.01% | 0.01% | 0.01% | 0.01% | 0.05% | 0.09% |
| G1397 DddAtox-N-SaKKH-Cas9 with saG4 gRNA | C | 0.00% | 0.00% | 0.05% | 0.01% | 0.02% | 0.04% | 0.03% | 0.01% | 0.02% | 0.00% | 99.92% | 99.87% |
| G1397 DddAtox-N-SaKKH-Cas9 with saG4 gRNA | G | 99.95% | 99.97% | 0.09% | 99.96% | 99.94% | 0.05% | 0.07% | 99.94% | 99.95% | 99.98% | 0.03% | 0.02% |
| G1397 DddAtox-N-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | A | 0.00% | 0.01% | 99.84% | 0.01% | 0.01% | 99.91% | 99.88% | 0.01% | 0.01% | 0.01% | 0.01% | 0.04% |
| G1397 DddAtox-C-SaKKH-Cas9 with saG4 gRNA | T | 0.02% | 0.01% | 0.02% | 0.02% | 0.01% | 0.01% | 0.00% | 0.01% | 0.01% | 0.02% | 0.03% | 0.09% |
| G1397 DddAtox-C-SaKKH-Cas9 with saG4 gRNA | C | 0.00% | 0.00% | 0.04% | 0.00% | 0.00% | 0.02% | 0.02% | 0.01% | 0.00% | 0.00% | 99.92% | 99.85% |
| G1397 DddAtox-C-SaKKH-Cas9 with saG4 gRNA | G | 99.98% | 99.97% | 0.10% | 99.97% | 99.97% | 0.06% | 0.09% | 99.98% | 99.98% | 99.97% | 0.04% | 0.02% |

TABLE 10A-continued

| KKH-Cas9 half with saG4 gRNA | | | | | | | | | | | | | |
|---|---|---|---|---|---|---|---|---|---|---|---|---|---|
| G1397 DddAtox-C-SaKKH-Cas9 with saG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-SaKKH-Cas9 with saG4 gRNA | — | 0.00% | 0.00% | 0.00% | 0.01% | 0.01% | 0.01% | 0.01% | 0.00% | 0.00% | 0.00% | 0.00% | 0.00% |

| Batch | Nucleotide | T | G | A | G | T | C | C | G |
|---|---|---|---|---|---|---|---|---|---|
| G1333 DddAtox-N-SaKKH-Cas9 with saG4 gRNA | A | 0.01% | 0.01% | 99.88% | 0.01% | 0.02% | 0.02% | 0.01% | 0.02% |
| G1333 DddAtox-N-SaKKH-Cas9 with saG4 gRNA | T | 99.91% | 0.01% | 0.00% | 0.01% | 99.80% | 0.03% | 0.04% | 0.01% |
| G1333 DddAtox-N-SaKKH-Cas9 with saG4 gRNA | C | 0.04% | 0.01% | 0.04% | 0.00% | 0.09% | 99.95% | 99.87% | 0.00% |
| G1333 DddAtox-N-SaKKH-Cas9 with saG4 gRNA | G | 0.03% | 99.97% | 0.08% | 99.97% | 0.06% | 0.01% | 0.01% | 99.92% |
| G1333 DddAtox-N-SaKKH-Cas9 with saG4 gRNA | N | 0.00% | 0.00% | 0.00% | 0.00% | 0.00% | 0.00% | 0.00% | 0.00% |
| G1333 DddAtox-N-SaKKH-Cas9 with saG4 gRNA | — | 0.00% | 0.00% | 0.00% | 0.01% | 0.03% | 0.00% | 0.07% | 0.04% |
| G1333 DddAtox-C-SaKKH-Cas9 with saG4 gRNA | A | 0.01% | 0.01% | 99.86% | 0.01% | 0.03% | 0.01% | 0.01% | 0.02% |
| G1333 DddAtox-C-SaKKH-Cas9 with saG4 gRNA | T | 99.89% | 0.02% | 0.01% | 0.01% | 99.79% | 0.04% | 0.05% | 0.00% |
| G1333 DddAtox-C-SaKKH-Cas9 with saG4 gRNA | C | 0.04% | 0.00% | 0.04% | 0.00% | 0.07% | 99.94% | 99.84% | 0.01% |
| G1333 DddAtox-C-SaKKH-Cas9 with saG4 gRNA | G | 0.05% | 99.97% | 0.09% | 99.95% | 0.07% | 0.01% | 0.03% | 99.91% |
| G1333 DddAtox-C-SaKKH-Cas9 with saG4 gRNA | N | 0.00% | 0.00% | 0.00% | 0.00% | 0.00% | 0.00% | 0.00% | 0.00% |
| G1333 DddAtox-C-SaKKH-Cas9 with saG4 gRNA | — | 0.00% | 0.00% | 0.00% | 0.03% | 0.04% | 0.00% | 0.08% | 0.06% |
| G1397 DddAtox-N-SaKKH-Cas9 with saG4 gRNA | A | 0.02% | 0.03% | 99.83% | 0.02% | 0.05% | 0.02% | 0.01% | 0.03% |
| G1397 DddAtox-N-SaKKH-Cas9 with saG4 gRNA | T | 99.89% | 0.01% | 0.01% | 0.00% | 99.75% | 0.05% | 0.06% | 0.01% |
| G1397 DddAtox-N-SaKKH-Cas9 with saG4 gRNA | C | 0.05% | 0.00% | 0.06% | 0.01% | 0.07% | 99.92% | 99.83% | 0.01% |
| G1397 DddAtox-N-SaKKH-Cas9 with saG4 gRNA | G | 0.04% | 99.96% | 0.09% | 99.95% | 0.08% | 0.01% | 0.01% | 99.89% |
| G1397 DddAtox-N-SaKKH-Cas9 with saG4 gRNA | N | 0.00% | 0.00% | 0.00% | 0.00% | 0.00% | 0.00% | 0.00% | 0.00% |
| G1397 DddAtox-N-SaKKH-Cas9 with saG4 gRNA | — | 0.00% | 0.00% | 0.00% | 0.02% | 0.05% | 0.00% | 0.09% | 0.07% |
| G1397 DddAtox-C-SaKKH-Cas9 with saG4 gRNA | A | 0.01% | 0.02% | 99.86% | 0.00% | 0.02% | 0.01% | 0.01% | 0.01% |
| G1397 DddAtox-C-SaKKH-Cas9 with saG4 gRNA | T | 99.90% | 0.02% | 0.01% | 0.01% | 99.79% | 0.03% | 0.05% | 0.01% |
| G1397 DddAtox-C-SaKKH-Cas9 with saG4 gRNA | C | 0.05% | 0.00% | 0.03% | 0.00% | 0.08% | 99.95% | 99.83% | 0.00% |
| G1397 DddAtox-C-SaKKH-Cas9 with saG4 gRNA | G | 0.04% | 99.97% | 0.09% | 99.96% | 0.07% | 0.01% | 0.02% | 99.90% |
| G1397 DddAtox-C-SaKKH-Cas9 with saG4 gRNA | N | 0.00% | 0.00% | 0.00% | 0.00% | 0.00% | 0.00% | 0.00% | 0.00% |

TABLE 10A-continued

| Batch | Nucleotide | A | G | C | A | G | A | A | G |
|---|---|---|---|---|---|---|---|---|---|
| KKH-Cas9 half with saG4 gRNA | | | | | | | | | |
| G1397 DddAtox-C-SaKKH-Cas9 with saG4 gRNA | — | 0.00% | 0.00% | 0.00% | 0.02% | 0.04% | 0.00% | 0.09% | 0.07% |
| G1333 DddAtox-N-SaKKH-Cas9 with saG4 gRNA | A | 99.85% | 0.01% | 0.04% | 3.03% | 0.08% | 2.92% | 1.01% | 0.00% |
| G1333 DddAtox-N-SaKKH-Cas9 with saG4 gRNA | T | 0.01% | 0.01% | 0.03% | 0.01% | 0.01% | 0.00% | 0.00% | 0.00% |
| G1333 DddAtox-N-SaKKH-Cas9 with saG4 gRNA | C | 0.02% | 0.01% | 99.89% | 0.05% | 0.00% | 0.02% | 0.00% | 0.00% |
| G1333 DddAtox-N-SaKKH-Cas9 with saG4 gRNA | G | 0.09% | 99.94% | 0.02% | 0.11% | 3.07% | 0.05% | 0.01% | 1.01% |
| G1333 DddAtox-N-SaKKH-Cas9 with saG4 gRNA | N | 0.00% | 0.00% | 0.00% | 0.00% | 0.00% | 0.00% | 0.00% | 0.00% |
| G1333 DddAtox-N-SaKKH-Cas9 with saG4 gRNA | — | 0.03% | 0.04% | 0.02% | 96.81% | 96.84% | 97.01% | 98.98% | 98.98% |
| G1333 DddAtox-C-SaKKH-Cas9 with saG4 gRNA | A | 99.85% | 0.01% | 0.03% | 2.89% | 0.10% | 2.75% | 0.74% | 0.00% |
| G1333 DddAtox-C-SaKKH-Cas9 with saG4 gRNA | T | 0.01% | 0.01% | 0.04% | 0.02% | 0.01% | 0.01% | 0.00% | 0.00% |
| G1333 DddAtox-C-SaKKH-Cas9 with saG4 gRNA | C | 0.02% | 0.01% | 99.87% | 0.04% | 0.00% | 0.03% | 0.01% | 0.00% |
| G1333 DddAtox-C-SaKKH-Cas9 with saG4 gRNA | G | 0.09% | 99.92% | 0.02% | 0.10% | 2.93% | 0.05% | 0.00% | 0.74% |
| G1333 DddAtox-C-SaKKH-Cas9 with saG4 gRNA | N | 0.00% | 0.00% | 0.00% | 0.00% | 0.00% | 0.00% | 0.00% | 0.00% |
| G1333 DddAtox-C-SaKKH-Cas9 with saG4 gRNA | — | 0.03% | 0.05% | 0.03% | 96.95% | 96.96% | 97.17% | 99.25% | 99.26% |
| G1397 DddAtox-N-SaKKH-Cas9 with saG4 gRNA | A | 99.81% | 0.01% | 0.03% | 6.28% | 0.10% | 6.13% | 4.18% | 0.00% |
| G1397 DddAtox-N-SaKKH-Cas9 with saG4 gRNA | T | 0.01% | 0.02% | 0.04% | 0.01% | 0.01% | 0.01% | 0.00% | 0.00% |
| G1397 DddAtox-N-SaKKH-Cas9 with saG4 gRNA | C | 0.03% | 0.01% | 99.88% | 0.06% | 0.01% | 0.02% | 0.01% | 0.00% |
| G1397 DddAtox-N-SaKKH-Cas9 with saG4 gRNA | G | 0.12% | 99.92% | 0.01% | 0.09% | 6.31% | 0.08% | 0.01% | 4.19% |
| G1397 DddAtox-N-SaKKH-Cas9 with saG4 gRNA | N | 0.00% | 0.00% | 0.00% | 0.00% | 0.00% | 0.00% | 0.00% | 0.00% |
| G1397 DddAtox-N-SaKKH-Cas9 with saG4 gRNA | — | 0.03% | 0.04% | 0.04% | 93.55% | 93.57% | 93.76% | 95.80% | 95.81% |
| G1397 DddAtox-C-SaKKH-Cas9 with saG4 gRNA | A | 99.84% | 0.01% | 0.03% | 3.12% | 0.11% | 2.98% | 0.75% | 0.00% |
| G1397 DddAtox-C-SaKKH-Cas9 with saG4 gRNA | T | 0.01% | 0.00% | 0.03% | 0.01% | 0.01% | 0.01% | 0.00% | 0.00% |
| G1397 DddAtox-C-SaKKH-Cas9 with saG4 gRNA | C | 0.04% | 0.01% | 99.88% | 0.03% | 0.00% | 0.01% | 0.00% | 0.00% |
| G1397 DddAtox-C-SaKKH-Cas9 with saG4 gRNA | G | 0.08% | 99.91% | 0.03% | 0.12% | 3.14% | 0.06% | 0.00% | 0.76% |
| G1397 DddAtox-C-SaKKH-Cas9 with saG4 gRNA | N | 0.00% | 0.00% | 0.00% | 0.00% | 0.00% | 0.00% | 0.00% | 0.00% |

TABLE 10A-continued

| KKH-Cas9 half with saG4 gRNA | | | | | | | | | |
|---|---|---|---|---|---|---|---|---|---|
| G1397 DddAtox-C-SaKKH-Cas9 with saG4 gRNA | — | 0.03% | 0.06% | 0.03% | 96.72% | 96.74% | 96.94% | 99.24% | 99.24% |

TABLE 10B dSpCas9 half with spG4 gRNA

| Batch | Nucle-otide | G | G | C | C | C | C | T | A | A | C | C | C |
|---|---|---|---|---|---|---|---|---|---|---|---|---|---|
| G1333 DddAtox-N-dSpCas9 with spG4 gRNA | A | 0.18% | 0.03% | 0.00% | 0.00% | 0.00% | 0.00% | 0.01% | 99.93% | 99.67% | 0.00% | 0.00% | 0.00% |
| G1333 DddAtox-N-dSpCas9 with spG4 gRNA | T | 0.20% | 0.03% | 0.01% | 0.00% | 0.01% | 0.00% | 99.93% | 0.00% | 0.00% | 0.01% | 0.01% | 0.01% |
| G1333 DddAtox-N-dSpCas9 with spG4 gRNA | C | 0.10% | 0.02% | 99.34% | 99.99% | 99.98% | 99.98% | 0.03% | 0.04% | 0.01% | 99.98% | 99.99% | 99.78% |
| G1333 DddAtox-N-dSpCas9 with spG4 gRNA | G | 99.51% | 99.92% | 0.65% | 0.01% | 0.00% | 0.00% | 0.00% | 0.02% | 0.01% | 0.00% | 0.00% | 0.00% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.01% | 0.01% | 0.03% | 0.00% | 0.30% | 0.01% | 0.00% | 0.20% |
| G1333 DddAtox-C-dSpCas9 with spG4 gRNA | A | 0.21% | 0.02% | 0.00% | 0.00% | 0.01% | 0.01% | 0.01% | 99.92% | 99.65% | 0.01% | 0.00% | 0.01% |
| G1333 DddAtox-C-dSpCas9 with spG4 gRNA | T | 0.22% | 0.03% | 0.00% | 0.01% | 0.00% | 0.00% | 99.92% | 0.00% | 0.00% | 0.00% | 0.01% | 0.00% |
| G1333 DddAtox-C-dSpCas9 with spG4 gRNA | C | 0.11% | 0.01% | 99.30% | 99.97% | 99.98% | 99.99% | 0.02% | 0.05% | 0.00% | 99.98% | 99.98% | 99.74% |
| G1333 DddAtox-C-dSpCas9 with spG4 gRNA | G | 99.47% | 99.94% | 0.69% | 0.02% | 0.00% | 0.00% | 0.00% | 0.02% | 0.01% | 0.00% | 0.00% | 0.00% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.05% | 0.01% | 0.33% | 0.01% | 0.00% | 0.24% |
| G1397 DddAtox-N-dSpCas9 with spG4 gRNA | A | 0.20% | 0.04% | 0.01% | 0.00% | 0.00% | 0.01% | 0.01% | 99.94% | 99.65% | 0.00% | 0.00% | 0.00% |
| G1397 DddAtox-N-dSpCas9 with spG4 gRNA | T | 0.23% | 0.03% | 0.01% | 0.00% | 0.01% | 0.01% | 99.93% | 0.01% | 0.00% | 0.01% | 0.01% | 0.01% |
| G1397 DddAtox-N-dSpCas9 with spG4 gRNA | C | 0.15% | 0.02% | 99.23% | 99.99% | 99.97% | 99.97% | 0.03% | 0.03% | 0.01% | 99.97% | 99.99% | 99.73% |
| G1397 DddAtox-N-dSpCas9 with spG4 gRNA | G | 99.41% | 99.91% | 0.75% | 0.01% | 0.00% | 0.00% | 0.00% | 0.02% | 0.01% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.01% | 0.02% | 0.03% | 0.00% | 0.34% | 0.01% | 0.00% | 0.26% |
| G1397 DddAtox-C-dSpCas9 with spG4 gRNA | A | 0.20% | 0.05% | 0.01% | 0.01% | 0.00% | 0.01% | 0.00% | 99.93% | 99.66% | 0.01% | 0.01% | 0.00% |
| G1397 DddAtox-C-dSpCas9 with spG4 gRNA | T | 0.24% | 0.03% | 0.00% | 0.00% | 0.00% | 0.01% | 99.93% | 0.00% | 0.01% | 0.01% | 0.00% | 0.00% |
| G1397 DddAtox-C-dSpCas9 with spG4 gRNA | C | 0.13% | 0.03% | 99.24% | 99.98% | 99.98% | 99.97% | 0.02% | 0.04% | 0.01% | 99.98% | 99.98% | 99.76% |
| G1397 DddAtox-C-dSpCas9 with spG4 gRNA | G | 99.44% | 99.89% | 0.75% | 0.01% | 0.00% | 0.00% | 0.00% | 0.02% | 0.01% | 0.00% | 0.00% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.01% | 0.01% | 0.04% | 0.01% | 0.31% | 0.01% | 0.01% | 0.23% |

| Batch | Nucle-otide | T | A | T | G | T | A | G | C | C | T | C | A |
|---|---|---|---|---|---|---|---|---|---|---|---|---|---|
| G1333 DddAtox-N-dSpCas9 with spG4 gRNA | A | 0.00% | 99.90% | 0.01% | 0.05% | 0.01% | 99.95% | 0.02% | 0.00% | 0.00% | 0.01% | 0.01% | 99.98% |
| G1333 DddAtox-N-dSpCas9 with spG4 gRNA | T | 99.97% | 0.02% | 99.97% | 0.04% | 99.97% | 0.00% | 0.04% | 0.00% | 0.00% | 99.97% | 0.01% | 0.00% |
| G1333 DddAtox-N-dSpCas9 with spG4 gRNA | C | 0.00% | 0.02% | 0.01% | 0.00% | 0.01% | 0.02% | 0.00% | 99.99% | 99.99% | 0.02% | 99.95% | 0.01% |
| G1333 DddAtox-N-dSpCas9 with spG4 gRNA | G | 0.00% | 0.02% | 0.00% | 99.91% | 0.00% | 0.03% | 99.94% | 0.00% | 0.00% | 0.00% | 0.03% | 0.01% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.02% | 0.03% | 0.01% | 0.00% | 0.00% | 0.00% | 0.00% | 0.00% | 0.00% | 0.00% | 0.00% | 0.00% |
| G1333 DddAtox-C-dSpCas9 with spG4 gRNA | A | 0.01% | 99.93% | 0.01% | 0.05% | 0.01% | 99.95% | 0.02% | 0.00% | 0.01% | 0.00% | 0.00% | 99.97% |
| G1333 DddAtox-C-dSpCas9 with spG4 gRNA | T | 99.96% | 0.00% | 99.96% | 0.04% | 99.97% | 0.00% | 0.05% | 0.00% | 0.01% | 99.98% | 0.01% | 0.01% |
| G1333 DddAtox-C-dSpCas9 with spG4 gRNA | C | 0.01% | 0.02% | 0.02% | 0.00% | 0.01% | 0.01% | 0.00% | 99.99% | 99.98% | 0.01% | 99.96% | 0.01% |
| G1333 DddAtox-C-dSpCas9 with spG4 gRNA | G | 0.00% | 0.01% | 0.00% | 99.90% | 0.00% | 0.03% | 99.93% | 0.00% | 0.00% | 0.00% | 0.02% | 0.01% |

TABLE 10B-continued

| dSpCas9 half with spG4 gRNA | | | | | | | | | | | | | |
|---|---|---|---|---|---|---|---|---|---|---|---|---|---|
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.02% | 0.03% | 0.01% | 0.00% | 0.00% | 0.00% | 0.00% | 0.00% | 0.00% | 0.00% | 0.00% | 0.00% |
| G1397 DddAtox-N-dSpCas9 with spG4 gRNA | A | 0.00% | 99.91% | 0.01% | 0.07% | 0.01% | 99.94% | 0.02% | 0.01% | 0.00% | 0.00% | 0.00% | 99.96% |
| G1397 DddAtox-N-dSpCas9 with spG4 gRNA | T | 99.95% | 0.01% | 99.97% | 0.03% | 99.97% | 0.00% | 0.05% | 0.00% | 0.01% | 99.98% | 0.02% | 0.01% |
| G1397 DddAtox-N-dSpCas9 with spG4 gRNA | C | 0.02% | 0.02% | 0.01% | 0.00% | 0.01% | 0.02% | 0.00% | 99.99% | 99.99% | 0.01% | 99.98% | 0.01% |
| G1397 DddAtox-N-dSpCas9 with spG4 gRNA | G | 0.00% | 0.02% | 0.00% | 99.90% | 0.00% | 0.04% | 99.93% | 0.00% | 0.00% | 0.00% | 0.00% | 0.02% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.02% | 0.04% | 0.01% | 0.00% | 0.00% | 0.00% | 0.00% | 0.00% | 0.00% | 0.00% | 0.00% | 0.00% |
| G1397 DddAtox-C-dSpCas9 with spG4 gRNA | A | 0.00% | 99.88% | 0.00% | 0.04% | 0.02% | 99.94% | 0.02% | 0.01% | 0.00% | 0.01% | 0.01% | 99.96% |
| G1397 DddAtox-C-dSpCas9 with spG4 gRNA | T | 99.96% | 0.02% | 99.98% | 0.03% | 99.96% | 0.00% | 0.05% | 0.00% | 0.01% | 99.97% | 0.01% | 0.01% |
| G1397 DddAtox-C-dSpCas9 with spG4 gRNA | C | 0.01% | 0.02% | 0.01% | 0.00% | 0.01% | 0.02% | 0.00% | 99.99% | 99.99% | 0.02% | 99.98% | 0.02% |
| G1397 DddAtox-C-dSpCas9 with spG4 gRNA | G | 0.00% | 0.02% | 0.00% | 99.92% | 0.00% | 0.03% | 99.93% | 0.00% | 0.00% | 0.00% | 0.00% | 0.02% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.03% | 0.05% | 0.01% | 0.00% | 0.00% | 0.00% | 0.00% | 0.00% | 0.00% | 0.00% | 0.00% | 0.00% |
| Batch | Nucleotide | G | T | C | T | T | C | C | C | A | T | C | A |
| G1333 DddAtox-N-dSpCas9 with spG4 gRNA | A | 0.01% | 0.01% | 0.01% | 0.00% | 0.00% | 0.02% | 0.01% | 0.01% | 99.95% | 0.01% | 0.01% | 99.96% |
| G1333 DddAtox-N-dSpCas9 with spG4 gRNA | T | 0.04% | 99.98% | 0.01% | 99.96% | 99.95% | 0.01% | 0.01% | 0.01% | 0.01% | 99.96% | 0.01% | 0.01% |
| G1333 DddAtox-N-dSpCas9 with spG4 gRNA | C | 0.00% | 0.01% | 99.98% | 0.04% | 0.01% | 99.97% | 99.95% | 99.97% | 0.01% | 0.01% | 99.98% | 0.01% |
| G1333 DddAtox-N-dSpCas9 with spG4 gRNA | G | 99.94% | 0.00% | 0.00% | 0.00% | 0.03% | 0.00% | 0.03% | 0.00% | 0.03% | 0.03% | 0.00% | 0.01% |

TABLE 10B-continued

| dSpCas9 half with spG4 gRNA | | | | | | | | | | | | | |
|---|---|---|---|---|---|---|---|---|---|---|---|---|---|
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | A | 0.00% | 0.01% | 0.00% | 0.00% | 0.00% | 0.01% | 0.00% | 0.01% | 99.95% | 0.01% | 0.00% | 99.96% |
| G1333 DddAtox-C-dSpCas9 with spG4 gRNA | T | 0.04% | 99.98% | 0.01% | 99.97% | 99.96% | 0.01% | 0.01% | 0.01% | 0.01% | 99.97% | 0.01% | 0.01% |
| G1333 DddAtox-C-dSpCas9 with spG4 gRNA | C | 0.00% | 0.01% | 99.99% | 0.03% | 0.01% | 99.98% | 99.97% | 99.97% | 0.01% | 0.01% | 99.98% | 0.01% |
| G1333 DddAtox-C-dSpCas9 with spG4 gRNA | G | 99.95% | 0.00% | 0.00% | 0.00% | 0.02% | 0.01% | 0.01% | 0.00% | 0.03% | 0.02% | 0.00% | 0.02% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | A | 0.01% | 0.01% | 0.01% | 0.00% | 0.00% | 0.00% | 0.01% | 0.01% | 99.96% | 0.00% | 0.00% | 99.97% |
| G1397 DddAtox-N-dSpCas9 with spG4 gRNA | T | 0.03% | 99.97% | 0.00% | 99.98% | 99.97% | 0.01% | 0.01% | 0.01% | 0.00% | 99.98% | 0.00% | 0.01% |
| G1397 DddAtox-N-dSpCas9 with spG4 gRNA | C | 0.00% | 0.02% | 99.99% | 0.02% | 0.01% | 99.99% | 99.98% | 99.98% | 0.01% | 0.01% | 99.99% | 0.01% |
| G1397 DddAtox-N-dSpCas9 with spG4 gRNA | G | 99.96% | 0.00% | 0.00% | 0.00% | 0.01% | 0.00% | 0.00% | 0.00% | 0.03% | 0.01% | 0.00% | 0.01% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | A | 0.01% | 0.00% | 0.00% | 0.00% | 0.00% | 0.00% | 0.01% | 0.01% | 99.96% | 0.01% | 0.01% | 99.96% |
| G1397 DddAtox-C-dSpCas9 with spG4 gRNA | T | 0.04% | 99.99% | 0.00% | 99.98% | 99.97% | 0.01% | 0.01% | 0.01% | 0.01% | 99.97% | 0.01% | 0.01% |
| G1397 DddAtox-C-dSpCas9 with spG4 gRNA | C | 0.00% | 0.01% | 99.99% | 0.01% | 0.02% | 99.99% | 99.98% | 99.99% | 0.01% | 0.01% | 99.98% | 0.01% |
| G1397 DddAtox-C-dSpCas9 with spG4 gRNA | G | 99.95% | 0.00% | 0.00% | 0.00% | 0.01% | 0.00% | 0.00% | 0.00% | 0.02% | 0.01% | 0.00% | 0.01% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| Batch | Nucle-otide | G | G | C | T | C | T | C | A | G | C | T | C |
| G1333 DddAtox-N-dSpCas9 with spG4 gRNA | A | 0.01% | 0.04% | 0.00% | 0.02% | 0.00% | 0.01% | 0.01% | 99.95% | 0.01% | 0.01% | 0.01% | 0.01% |
| G1333 DddAtox-N-dSpCas9 with spG4 gRNA | T | 0.04% | 0.01% | 0.01% | 99.97% | 0.01% | 99.97% | 0.01% | 0.00% | 0.01% | 0.01% | 99.97% | 0.01% |
| G1333 DddAtox-N-dSpCas9 with spG4 gRNA | C | 0.00% | 0.00% | 99.96% | 0.01% | 99.98% | 0.01% | 99.96% | 0.01% | 0.00% | 99.98% | 0.01% | 99.97% |
| G1333 DddAtox-N-dSpCas9 with spG4 gRNA | G | 99.95% | 99.93% | 0.03% | 0.00% | 0.00% | 0.00% | 0.02% | 0.04% | 99.98% | 0.00% | 0.02% | 0.00% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | A | 0.01% | 0.02% | 0.00% | 0.00% | 0.01% | 0.01% | 0.01% | 99.96% | 0.02% | 0.00% | 0.01% | 0.00% |
| G1333 DddAtox-C-dSpCas9 with spG4 gRNA | T | 0.04% | 0.00% | 0.00% | 99.97% | 0.00% | 99.98% | 0.00% | 0.00% | 0.01% | 0.00% | 99.96% | 0.01% |
| G1333 DddAtox-C-dSpCas9 with spG4 gRNA | C | 0.00% | 0.01% | 99.98% | 0.02% | 99.99% | 0.01% | 99.98% | 0.01% | 0.00% | 99.99% | 0.01% | 99.98% |
| G1333 DddAtox-C-dSpCas9 with spG4 gRNA | G | 99.95% | 99.97% | 0.01% | 0.00% | 0.00% | 0.01% | 0.01% | 0.03% | 99.97% | 0.00% | 0.02% | 0.00% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | A | 0.00% | 0.01% | 0.00% | 0.00% | 0.01% | 0.01% | 0.00% | 99.96% | 0.01% | 0.00% | 0.00% | 0.01% |
| G1397 DddAtox-N-dSpCas9 with spG4 gRNA | T | 0.03% | 0.01% | 0.01% | 99.99% | 0.01% | 99.98% | 0.01% | 0.00% | 0.01% | 0.01% | 99.98% | 0.02% |
| G1397 DddAtox-N-dSpCas9 with spG4 gRNA | C | 0.00% | 0.00% | 99.99% | 0.01% | 99.99% | 0.01% | 99.98% | 0.01% | 0.00% | 99.99% | 0.01% | 99.97% |
| G1397 DddAtox-N-dSpCas9 with spG4 gRNA | G | 99.96% | 99.97% | 0.00% | 0.00% | 0.00% | 0.00% | 0.00% | 0.02% | 99.98% | 0.00% | 0.00% | 0.00% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1397 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | A | 0.01% | 0.01% | 0.00% | 0.00% | 0.00% | 0.00% | 0.01% | 99.96% | 0.01% | 0.00% | 0.01% | 0.01% |
| G1397 DddAtox-C-dSpCas9 with spG4 gRNA | T | 0.04% | 0.01% | 0.00% | 99.99% | 0.01% | 99.99% | 0.01% | 0.00% | 0.01% | 0.01% | 99.98% | 0.01% |
| G1397 DddAtox-C-dSpCas9 with spG4 gRNA | C | 0.00% | 0.01% | 100.00% | 0.01% | 99.99% | 0.01% | 99.99% | 0.01% | 0.00% | 99.98% | 0.01% | 99.98% |
| G1397 DddAtox-C-dSpCas9 with spG4 gRNA | G | 99.95% | 99.97% | 0.00% | 0.00% | 0.00% | 0.00% | 0.00% | 0.03% | 99.98% | 0.00% | 0.01% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucle-otide | A | G | C | C | T | G | A | G | T | G | T | T |
|---|---|---|---|---|---|---|---|---|---|---|---|---|---|
| G1333 DddAtox-N-dSpCas9 with spG4 gRNA | A | 99.95% | 0.00% | 0.03% | 0.01% | 0.00% | 0.01% | 99.94% | 0.01% | 0.02% | 0.01% | 0.01% | 0.01% |
| G1333 DddAtox-N-dSpCas9 with spG4 gRNA | T | 0.00% | 0.00% | 0.01% | 0.00% | 99.97% | 0.01% | 0.01% | 0.01% | 99.92% | 0.03% | 99.92% | 99.95% |
| G1333 DddAtox-N-dSpCas9 with spG4 gRNA | C | 0.00% | 0.01% | 99.96% | 99.98% | 0.01% | 0.01% | 0.01% | 0.01% | 0.04% | 0.01% | 0.02% | 0.02% |
| G1333 DddAtox-N-dSpCas9 with spG4 gRNA | G | 0.04% | 99.98% | 0.00% | 0.00% | 0.00% | 99.97% | 0.04% | 99.98% | 0.01% | 99.94% | 0.04% | 0.01% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.01% | 0.01% | 0.00% | 0.00% | 0.01% | 0.01% | 0.01% | 0.01% |
| G1333 DddAtox-C-dSpCas9 with spG4 gRNA | A | 99.96% | 0.02% | 0.01% | 0.00% | 0.01% | 0.01% | 99.93% | 0.01% | 0.01% | 0.00% | 0.00% | 0.00% |
| G1333 DddAtox-C-dSpCas9 with spG4 gRNA | T | 0.00% | 0.01% | 0.01% | 0.00% | 99.96% | 0.01% | 0.01% | 0.01% | 99.94% | 0.03% | 99.95% | 99.97% |
| G1333 DddAtox-C-dSpCas9 with spG4 gRNA | C | 0.01% | 0.02% | 99.98% | 99.99% | 0.02% | 0.01% | 0.01% | 0.00% | 0.03% | 0.00% | 0.02% | 0.02% |
| G1333 DddAtox-C-dSpCas9 with spG4 gRNA | G | 0.03% | 99.95% | 0.00% | 0.00% | 0.00% | 99.96% | 0.04% | 99.98% | 0.02% | 99.96% | 0.02% | 0.00% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |

TABLE 10B-continued

| | | | | | | | | | | | | | |
|---|---|---|---|---|---|---|---|---|---|---|---|---|---|
| dSpCas9 half with spG4 gRNA | | | | | | | | | | | | | |
| G1333 DddAtox-C-dSpCas9 with spG4 gRNA | — | 0.00% | 0.00% | 0.00% | 0.00% | 0.01% | 0.01% | 0.00% | 0.00% | 0.00% | 0.00% | 0.00% | 0.00% |
| G1397 DddAtox-N-dSpCas9 with spG4 gRNA | A | 99.97% | 0.01% | 0.00% | 0.00% | 0.01% | 0.01% | 99.96% | 0.00% | 0.01% | 0.01% | 0.00% | 0.00% |
| G1397 DddAtox-N-dSpCas9 with spG4 gRNA | T | 0.01% | 0.01% | 0.01% | 0.01% | 99.98% | 0.01% | 0.00% | 0.01% | 99.96% | 0.02% | 99.96% | 99.97% |
| G1397 DddAtox-N-dSpCas9 with spG4 gRNA | C | 0.01% | 0.00% | 99.99% | 99.99% | 0.01% | 0.00% | 0.01% | 0.00% | 0.01% | 0.00% | 0.02% | 0.02% |
| G1397 DddAtox-N-dSpCas9 with spG4 gRNA | G | 0.02% | 99.98% | 0.00% | 0.00% | 0.01% | 99.97% | 0.02% | 99.99% | 0.02% | 99.97% | 0.01% | 0.00% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | A | 99.97% | 0.01% | 0.00% | 0.00% | 0.00% | 0.01% | 99.96% | 0.01% | 0.02% | 0.01% | 0.01% | 0.00% |
| G1397 DddAtox-C-dSpCas9 with spG4 gRNA | T | 0.00% | 0.01% | 0.01% | 0.01% | 99.97% | 0.01% | 0.01% | 0.01% | 99.95% | 0.02% | 99.97% | 99.98% |
| G1397 DddAtox-C-dSpCas9 with spG4 gRNA | C | 0.01% | 0.00% | 99.99% | 99.98% | 0.02% | 0.00% | 0.02% | 0.00% | 0.01% | 0.00% | 0.01% | 0.02% |
| G1397 DddAtox-C-dSpCas9 with spG4 gRNA | G | 0.02% | 99.98% | 0.00% | 0.00% | 0.00% | 99.98% | 0.01% | 99.99% | 0.01% | 99.97% | 0.01% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucle-otide | G | A | G | G | C | C | C | C | A | G | T | G |
|---|---|---|---|---|---|---|---|---|---|---|---|---|---|
| G1333 DddAtox-N-dSpCas9 with spG4 gRNA | A | 0.04% | 99.93% | 0.02% | 0.01% | 0.00% | 0.02% | 0.01% | 0.01% | 99.94% | 0.02% | 0.02% | 0.02% |
| G1333 DddAtox-N-dSpCas9 with spG4 gRNA | T | 0.01% | 0.01% | 0.04% | 0.01% | 0.01% | 0.02% | 0.01% | 0.01% | 0.01% | 0.01% | 99.92% | 0.02% |
| G1333 DddAtox-N-dSpCas9 with spG4 gRNA | C | 0.01% | 0.04% | 0.01% | 0.01% | 99.98% | 99.96% | 99.97% | 99.96% | 0.02% | 0.00% | 0.04% | 0.02% |
| G1333 DddAtox-N-dSpCas9 with spG4 gRNA | G | 99.92% | 0.01% | 99.92% | 99.95% | 0.00% | 0.00% | 0.01% | 0.00% | 0.02% | 99.96% | 0.01% | 99.94% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1333 DddAtox-N-dSpCas9 with spG4 gRNA | — | 0.01% | 0.01% | 0.01% | 0.02% | 0.00% | 0.00% | 0.00% | 0.01% | 0.01% | 0.00% | 0.00% | 0.00% |
| G1333 DddAtox-C-dSpCas9 with spG4 gRNA | A | 0.04% | 99.93% | 0.01% | 0.01% | 0.01% | 0.02% | 0.00% | 0.02% | 99.94% | 0.02% | 0.02% | 0.01% |
| G1333 DddAtox-C-dSpCas9 with spG4 gRNA | T | 0.01% | 0.00% | 0.05% | 0.01% | 0.02% | 0.01% | 0.01% | 0.02% | 0.01% | 0.02% | 99.93% | 0.01% |
| G1333 DddAtox-C-dSpCas9 with spG4 gRNA | C | 0.01% | 0.05% | 0.01% | 0.01% | 99.97% | 99.97% | 99.97% | 99.94% | 0.03% | 0.00% | 0.04% | 0.02% |
| G1333 DddAtox-C-dSpCas9 with spG4 gRNA | G | 99.94% | 0.01% | 99.93% | 99.96% | 0.01% | 0.00% | 0.01% | 0.00% | 0.01% | 99.95% | 0.01% | 99.95% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.03% | 0.01% | 0.01% | 0.01% | 0.01% |
| G1397 DddAtox-N-dSpCas9 with spG4 gRNA | A | 0.02% | 99.95% | 0.01% | 0.01% | 0.00% | 0.00% | 0.01% | 0.01% | 99.96% | 0.01% | 0.02% | 0.01% |
| G1397 DddAtox-N-dSpCas9 with spG4 gRNA | T | 0.01% | 0.00% | 0.02% | 0.01% | 0.00% | 0.01% | 0.01% | 0.01% | 0.01% | 0.01% | 99.95% | 0.01% |
| G1397 DddAtox-N-dSpCas9 with spG4 gRNA | C | 0.00% | 0.02% | 0.00% | 0.00% | 99.99% | 99.98% | 99.98% | 99.96% | 0.02% | 0.00% | 0.02% | 0.00% |
| G1397 DddAtox-N-dSpCas9 with spG4 gRNA | G | 99.96% | 0.01% | 99.96% | 99.98% | 0.00% | 0.00% | 0.00% | 0.00% | 0.02% | 99.98% | 0.02% | 99.98% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.01% | 0.00% | 0.00% | 0.00% | 0.00% | 0.00% | 0.00% | 0.02% | 0.00% | 0.00% | 0.00% | 0.00% |
| G1397 DddAtox-C-dSpCas9 with spG4 gRNA | A | 0.01% | 99.95% | 0.01% | 0.01% | 0.00% | 0.00% | 0.01% | 0.01% | 99.95% | 0.01% | 0.02% | 0.01% |
| G1397 DddAtox-C-dSpCas9 with spG4 gRNA | T | 0.01% | 0.01% | 0.02% | 0.01% | 0.01% | 0.00% | 0.01% | 0.01% | 0.01% | 0.01% | 99.94% | 0.01% |
| G1397 DddAtox-C-dSpCas9 with spG4 gRNA | C | 0.00% | 0.03% | 0.00% | 0.00% | 99.98% | 100.00 | 99.98% | 99.95% | 0.01% | 0.00% | 0.02% | 0.01% |
| G1397 DddAtox-C-dSpCas9 with spG4 gRNA | G | 99.96% | 0.01% | 99.96% | 99.97% | 0.00% | 0.00% | 0.00% | 0.01% | 0.03% | 99.99% | 0.01% | 99.97% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.01% | 0.00% | 0.00% | 0.00% | 0.00% | 0.00% | 0.00% | 0.02% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| Batch | Nucle-otide | G | C | T | G | C | T | C | T | G | G | G | G |
| G1333 DddAtox-N-dSpCas9 with spG4 gRNA | A | 0.03% | 0.01% | 0.01% | 0.01% | 0.01% | 0.01% | 0.01% | 0.00% | 0.01% | 0.02% | 0.01% | 0.01% |
| G1333 DddAtox-N-dSpCas9 with spG4 gRNA | T | 0.01% | 0.00% | 99.95% | 0.02% | 0.00% | 99.97% | 0.01% | 99.97% | 0.02% | 0.02% | 0.05% | 0.02% |
| G1333 DddAtox-N-dSpCas9 with spG4 gRNA | C | 0.01% | 99.98% | 0.03% | 0.01% | 99.96% | 0.01% | 99.98% | 0.01% | 0.01% | 0.01% | 0.00% | 0.01% |
| G1333 DddAtox-N-dSpCas9 with spG4 gRNA | G | 99.95% | 0.01% | 0.00% | 99.96% | 0.02% | 0.01% | 0.00% | 0.01% | 99.96% | 99.95% | 99.94% | 99.95% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.01% | 0.00% | 0.00% | 0.01% | 0.01% |
| G1333 DddAtox-C-dSpCas9 with spG4 gRNA | A | 0.01% | 0.01% | 0.02% | 0.01% | 0.00% | 0.00% | 0.01% | 0.00% | 0.01% | 0.01% | 0.01% | 0.02% |
| G1333 DddAtox-C-dSpCas9 with spG4 gRNA | T | 0.01% | 0.01% | 99.67% | 0.02% | 0.00% | 99.66% | 0.00% | 99.69% | 0.01% | 0.03% | 0.04% | 0.02% |
| G1333 DddAtox-C-dSpCas9 with spG4 gRNA | C | 0.01% | 99.98% | 0.03% | 0.00% | 99.69% | 0.01% | 99.70% | 0.02% | 0.01% | 0.00% | 0.01% | 0.01% |
| G1333 DddAtox-C-dSpCas9 with spG4 gRNA | G | 99.96% | 0.00% | 0.00% | 99.68% | 0.02% | 0.00% | 0.00% | 0.00% | 99.68% | 99.67% | 99.65% | 99.65% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.01% | 0.01% | 0.28% | 0.28% | 0.29% | 0.29% | 0.29% | 0.29% | 0.29% | 0.29% | 0.29% | 0.30% |
| G1397 DddAtox-N-dSpCas9 with spG4 gRNA | A | 0.01% | 0.00% | 0.00% | 0.01% | 0.00% | 0.00% | 0.01% | 0.00% | 0.01% | 0.01% | 0.01% | 0.02% |
| G1397 DddAtox-N-dSpCas9 with spG4 gRNA | T | 0.01% | 0.00% | 99.98% | 0.02% | 0.00% | 99.76% | 0.01% | 99.75% | 0.01% | 0.02% | 0.02% | 0.02% |
| G1397 DddAtox-N-dSpCas9 with spG4 gRNA | C | 0.00% | 99.99% | 0.01% | 0.00% | 99.76% | 0.01% | 99.76% | 0.01% | 0.00% | 0.00% | 0.00% | 0.00% |
| G1397 DddAtox-N-dSpCas9 with spG4 gRNA | G | 99.97% | 0.00% | 0.00% | 99.97% | 0.00% | 0.01% | 0.00% | 0.00% | 99.75% | 99.75% | 99.74% | 99.74% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.22% | 0.22% | 0.23% | 0.23% | 0.22% | 0.22% | 0.22% | 0.23% |

TABLE 10B-continued

| dSpCas9 half with spG4 gRNA | | | | | | | | | | | | | |
|---|---|---|---|---|---|---|---|---|---|---|---|---|---|
| G1397 DddAtox-C-dSpCas9 with spG4 gRNA | A | 0.00% | 0.00% | 0.01% | 0.01% | 0.01% | 0.00% | 0.01% | 0.01% | 0.01% | 0.01% | 0.01% | 0.01% |
| G1397 DddAtox-C-dSpCas9 with spG4 gRNA | T | 0.01% | 0.01% | 99.97% | 0.02% | 0.01% | 99.98% | 0.00% | 99.97% | 0.02% | 0.01% | 0.02% | 0.01% |
| G1397 DddAtox-C-dSpCas9 with spG4 gRNA | C | 0.00% | 99.99% | 0.01% | 0.00% | 99.99% | 0.01% | 99.99% | 0.01% | 0.01% | 0.01% | 0.00% | 0.00% |
| G1397 DddAtox-C-dSpCas9 with spG4 gRNA | G | 99.98% | 0.00% | 0.00% | 99.97% | 0.00% | 0.01% | 0.00% | 0.00% | 99.96% | 99.97% | 99.96% | 99.97% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.01% |

| Batch | Nucle-otide | G | C | C | T | C | C | T | G | A | G | T | T |
|---|---|---|---|---|---|---|---|---|---|---|---|---|---|
| G1333 DddAtox-N-dSpCas9 with spG4 gRNA | A | 0.00% | 0.00% | 0.04% | 0.01% | 0.01% | 0.01% | 0.01% | 0.01% | 99.91% | 0.00% | 0.00% | 0.00% |
| G1333 DddAtox-N-dSpCas9 with spG4 gRNA | T | 0.01% | 0.01% | 0.01% | 99.95% | 0.01% | 0.01% | 99.96% | 0.01% | 0.02% | 0.01% | 99.96% | 99.97% |
| G1333 DddAtox-N-dSpCas9 with spG4 gRNA | C | 0.01% | 99.98% | 99.94% | 0.02% | 99.97% | 99.97% | 0.02% | 0.00% | 0.03% | 0.01% | 0.02% | 0.01% |
| G1333 DddAtox-N-dSpCas9 with spG4 gRNA | G | 99.94% | 0.00% | 0.01% | 0.01% | 0.01% | 0.00% | 0.00% | 99.96% | 0.03% | 99.97% | 0.01% | 0.00% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.04% | 0.00% | 0.01% | 0.01% | 0.01% | 0.01% | 0.01% | 0.01% | 0.01% | 0.01% | 0.01% | 0.01% |
| G1333 DddAtox-C-dSpCas9 with spG4 gRNA | A | 0.01% | 0.00% | 0.08% | 0.01% | 0.01% | 0.01% | 0.01% | 0.02% | 99.62% | 0.00% | 0.01% | 0.00% |
| G1333 DddAtox-C-dSpCas9 with spG4 gRNA | T | 0.01% | 0.00% | 0.02% | 99.68% | 0.01% | 0.01% | 99.66% | 0.02% | 0.01% | 0.01% | 99.65% | 99.69% |
| G1333 DddAtox-C-dSpCas9 with spG4 gRNA | C | 0.01% | 99.69% | 99.60% | 0.01% | 99.68% | 99.69% | 0.02% | 0.01% | 0.04% | 0.00% | 0.02% | 0.00% |
| G1333 DddAtox-C-dSpCas9 with spG4 gRNA | G | 99.66% | 0.00% | 0.01% | 0.00% | 0.00% | 0.00% | 0.01% | 99.66% | 0.02% | 99.68% | 0.01% | 0.00% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.31% | 0.30% | 0.30% | 0.30% | 0.30% | 0.30% | 0.30% | 0.30% | 0.30% | 0.30% | 0.31% | 0.31% |

TABLE 10B-continued dSpCas9 half with spG4 gRNA

| | | | | | | | | | | | | | |
|---|---|---|---|---|---|---|---|---|---|---|---|---|---|
| G1397 DddAtox-N-dSpCas9 with spG4 gRNA | A | 0.01% | 0.00% | 0.04% | 0.01% | 0.00% | 0.01% | 0.01% | 0.01% | 99.71% | 0.00% | 0.01% | 0.00% |
| G1397 DddAtox-N-dSpCas9 with spG4 gRNA | T | 0.01% | 0.01% | 0.01% | 99.75% | 0.01% | 0.01% | 99.74% | 0.02% | 0.00% | 0.01% | 99.74% | 99.77% |
| G1397 DddAtox-N-dSpCas9 with spG4 gRNA | C | 0.01% | 99.76% | 99.73% | 0.01% | 99.76% | 99.75% | 0.02% | 0.00% | 0.03% | 0.00% | 0.02% | 0.00% |
| G1397 DddAtox-N-dSpCas9 with spG4 gRNA | G | 99.72% | 0.00% | 0.00% | 0.00% | 0.00% | 0.00% | 0.00% | 99.74% | 0.03% | 99.76% | 0.00% | 0.00% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.26% | 0.23% | 0.23% | 0.23% | 0.23% | 0.23% | 0.23% | 0.23% | 0.23% | 0.23% | 0.23% | 0.23% |
| G1397 DddAtox-C-dSpCas9 with spG4 gRNA | A | 0.01% | 0.00% | 0.02% | 0.01% | 0.00% | 0.01% | 0.01% | 0.01% | 99.91% | 0.00% | 0.00% | 0.00% |
| G1397 DddAtox-C-dSpCas9 with spG4 gRNA | T | 0.01% | 0.01% | 0.01% | 99.97% | 0.02% | 0.01% | 99.97% | 0.01% | 0.01% | 0.01% | 99.96% | 99.98% |
| G1397 DddAtox-C-dSpCas9 with spG4 gRNA | C | 0.00% | 99.98% | 99.97% | 0.01% | 99.97% | 99.98% | 0.02% | 0.00% | 0.04% | 0.00% | 0.02% | 0.01% |
| G1397 DddAtox-C-dSpCas9 with spG4 gRNA | G | 99.95% | 0.01% | 0.00% | 0.01% | 0.00% | 0.00% | 0.00% | 99.98% | 0.03% | 99.98% | 0.02% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.03% | 0.00% | 0.00% | 0.00% | 0.00% | 0.00% | 0.00% | 0.00% | 0.00% | 0.01% | 0.01% | 0.01% |

| Batch | Nucleotide | T | C | T | C | A | T | C | T | G | T | G | C |
|---|---|---|---|---|---|---|---|---|---|---|---|---|---|
| G1333 DddAtox-N-dSpCas9 with spG4 gRNA | A | 0.00% | 0.00% | 0.01% | 0.01% | 99.95% | 0.01% | 0.01% | 0.02% | 0.02% | 0.02% | 0.04% | 0.01% |
| G1333 DddAtox-N-dSpCas9 with spG4 gRNA | T | 99.97% | 0.02% | 99.95% | 0.01% | 0.01% | 99.97% | 0.01% | 99.96% | 0.02% | 99.92% | 0.01% | 0.01% |
| G1333 DddAtox-N-dSpCas9 with spG4 gRNA | C | 0.01% | 99.96% | 0.01% | 99.97% | 0.02% | 0.01% | 99.96% | 0.01% | 0.00% | 0.03% | 0.01% | 99.97% |
| G1333 DddAtox-N-dSpCas9 with spG4 gRNA | G | 0.00% | 0.01% | 0.02% | 0.00% | 0.02% | 0.00% | 0.01% | 0.00% | 99.96% | 0.02% | 99.93% | 0.00% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.01% | 0.01% | 0.01% | 0.01% | 0.01% | 0.01% | 0.01% | 0.01% | 0.01% | 0.01% | 0.01% | 0.01% |

TABLE 10B-continued

| dSpCas9 half with spG4 gRNA | | | | | | | | | | | | | |
|---|---|---|---|---|---|---|---|---|---|---|---|---|---|
| G1333 DddAtox-C-dSpCas9 with spG4 gRNA | A | 0.00% | 0.00% | 0.01% | 0.00% | 99.66% | 0.01% | 0.01% | 0.01% | 0.02% | 0.03% | 0.02% | 0.01% |
| G1333 DddAtox-C-dSpCas9 with spG4 gRNA | T | 99.68% | 0.01% | 99.65% | 0.01% | 0.01% | 99.67% | 0.01% | 99.67% | 0.01% | 99.60% | 0.02% | 0.01% |
| G1333 DddAtox-C-dSpCas9 with spG4 gRNA | C | 0.01% | 99.68% | 0.01% | 99.67% | 0.02% | 0.01% | 99.67% | 0.01% | 0.00% | 0.04% | 0.00% | 99.67% |
| G1333 DddAtox-C-dSpCas9 with spG4 gRNA | G | 0.00% | 0.00% | 0.02% | 0.00% | 0.01% | 0.00% | 0.01% | 0.00% | 99.67% | 0.02% | 99.65% | 0.01% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.31% | 0.31% | 0.31% | 0.31% | 0.31% | 0.31% | 0.31% | 0.31% | 0.30% | 0.30% | 0.30% | 0.31% |
| G1397 DddAtox-N-dSpCas9 with spG4 gRNA | A | 0.00% | 0.00% | 0.01% | 0.01% | 99.75% | 0.00% | 0.01% | 0.01% | 0.01% | 0.02% | 0.02% | 0.00% |
| G1397 DddAtox-N-dSpCas9 with spG4 gRNA | T | 99.76% | 0.00% | 99.74% | 0.01% | 0.00% | 99.76% | 0.01% | 99.76% | 0.01% | 99.71% | 0.02% | 0.01% |
| G1397 DddAtox-N-dSpCas9 with spG4 gRNA | C | 0.01% | 99.76% | 0.01% | 99.75% | 0.01% | 0.01% | 99.76% | 0.01% | 0.00% | 0.02% | 0.01% | 99.76% |
| G1397 DddAtox-N-dSpCas9 with spG4 gRNA | G | 0.00% | 0.00% | 0.00% | 0.00% | 0.01% | 0.00% | 0.00% | 0.00% | 99.75% | 0.02% | 99.73% | 0.00% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.23% | 0.23% | 0.23% | 0.23% | 0.23% | 0.23% | 0.23% | 0.23% | 0.23% | 0.23% | 0.23% | 0.23% |
| G1397 DddAtox-C-dSpCas9 with spG4 gRNA | A | 0.00% | 0.01% | 0.01% | 0.01% | 99.96% | 0.01% | 0.00% | 0.01% | 0.01% | 0.02% | 0.02% | 0.01% |
| G1397 DddAtox-C-dSpCas9 with spG4 gRNA | T | 99.98% | 0.01% | 99.96% | 0.01% | 0.01% | 99.97% | 0.01% | 99.97% | 0.02% | 99.93% | 0.01% | 0.01% |
| G1397 DddAtox-C-dSpCas9 with spG4 gRNA | C | 0.01% | 99.97% | 0.01% | 99.97% | 0.02% | 0.01% | 99.98% | 0.01% | 0.00% | 0.02% | 0.01% | 99.97% |
| G1397 DddAtox-C-dSpCas9 with spG4 gRNA | G | 0.00% | 0.01% | 0.01% | 0.00% | 0.01% | 0.00% | 0.00% | 0.00% | 99.96% | 0.01% | 99.95% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.01% | 0.01% | 0.01% | 0.01% | 0.01% | 0.01% | 0.01% | 0.01% | 0.01% | 0.01% | 0.01% | 0.01% |

TABLE 10B-continued

| dSpCas9 half with spG4 gRNA | | | | | | | | | | | | | |
|---|---|---|---|---|---|---|---|---|---|---|---|---|---|
| Batch | Nucle-otide | C | C | C | T | C | C | C | T | C | C | C | T |
| G1333 DddAtox-N-dSpCas9 with spG4 gRNA | A | 0.00% | 0.02% | 0.01% | 0.01% | 0.01% | 0.01% | 0.04% | 0.01% | 0.01% | 0.01% | 0.02% | 0.00% |
| G1333 DddAtox-N-dSpCas9 with spG4 gRNA | T | 0.01% | 0.01% | 0.02% | 99.95% | 0.02% | 0.02% | 0.01% | 99.97% | 0.02% | 0.01% | 0.00% | 99.92% |
| G1333 DddAtox-N-dSpCas9 with spG4 gRNA | C | 99.97% | 99.96% | 99.95% | 0.02% | 99.97% | 99.96% | 99.93% | 0.01% | 99.95% | 99.95% | 99.94% | 0.03% |
| G1333 DddAtox-N-dSpCas9 with spG4 gRNA | G | 0.00% | 0.00% | 0.00% | 0.01% | 0.00% | 0.00% | 0.00% | 0.00% | 0.00% | 0.00% | 0.00% | 0.01% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.01% | 0.01% | 0.02% | 0.01% | 0.01% | 0.01% | 0.02% | 0.01% | 0.02% | 0.02% | 0.03% | 0.03% |
| G1333 DddAtox-C-dSpCas9 with spG4 gRNA | A | 0.01% | 0.02% | 0.01% | 0.00% | 0.01% | 0.01% | 0.01% | 0.01% | 0.00% | 0.01% | 0.03% | 0.01% |
| G1333 DddAtox-C-dSpCas9 with spG4 gRNA | T | 0.01% | 0.00% | 0.01% | 99.67% | 0.02% | 0.02% | 0.01% | 99.66% | 0.02% | 0.01% | 0.01% | 99.62% |
| G1333 DddAtox-C-dSpCas9 with spG4 gRNA | C | 99.67% | 99.67% | 99.65% | 0.01% | 99.65% | 99.66% | 99.67% | 0.02% | 99.65% | 99.65% | 99.62% | 0.03% |
| G1333 DddAtox-C-dSpCas9 with spG4 gRNA | G | 0.00% | 0.00% | 0.00% | 0.00% | 0.00% | 0.00% | 0.00% | 0.00% | 0.00% | 0.00% | 0.00% | 0.02% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.31% | 0.31% | 0.32% | 0.31% | 0.31% | 0.31% | 0.31% | 0.31% | 0.33% | 0.33% | 0.33% | 0.33% |
| G1397 DddAtox-N-dSpCas9 with spG4 gRNA | A | 0.00% | 0.01% | 0.01% | 0.01% | 0.01% | 0.01% | 0.03% | 0.00% | 0.01% | 0.03% | 0.02% | 0.01% |
| G1397 DddAtox-N-dSpCas9 with spG4 gRNA | T | 0.00% | 0.01% | 0.00% | 99.73% | 0.02% | 0.02% | 0.01% | 99.75% | 0.02% | 0.01% | 0.00% | 99.71% |
| G1397 DddAtox-N-dSpCas9 with spG4 gRNA | C | 99.76% | 99.76% | 99.74% | 0.02% | 99.74% | 99.74% | 99.73% | 0.01% | 99.73% | 99.72% | 99.73% | 0.03% |
| G1397 DddAtox-N-dSpCas9 with spG4 gRNA | G | 0.00% | 0.00% | 0.00% | 0.00% | 0.00% | 0.00% | 0.00% | 0.00% | 0.00% | 0.00% | 0.00% | 0.01% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.23% | 0.23% | 0.24% | 0.23% | 0.23% | 0.23% | 0.23% | 0.23% | 0.24% | 0.24% | 0.24% | 0.24% |

TABLE 10B-continued

| | | | | | | | | | | | | | |
|---|---|---|---|---|---|---|---|---|---|---|---|---|---|
| dSpCas9 half with spG4 gRNA | | | | | | | | | | | | | |
| G1397 DddAtox-C-dSpCas9 with spG4 gRNA | A | 0.01% | 0.02% | 0.01% | 0.01% | 0.01% | 0.01% | 0.02% | 0.01% | 0.01% | 0.02% | 0.02% | 0.01% |
| G1397 DddAtox-C-dSpCas9 with spG4 gRNA | T | 0.01% | 0.01% | 0.01% | 99.95% | 0.01% | 0.05% | 0.01% | 99.96% | 0.01% | 0.01% | 0.01% | 99.89% |
| G1397 DddAtox-C-dSpCas9 with spG4 gRNA | C | 99.97% | 99.96% | 99.96% | 0.03% | 99.97% | 99.93% | 99.96% | 0.02% | 99.95% | 99.94% | 99.93% | 0.05% |
| G1397 DddAtox-C-dSpCas9 with spG4 gRNA | G | 0.01% | 0.00% | 0.00% | 0.00% | 0.00% | 0.00% | 0.00% | 0.00% | 0.00% | 0.00% | 0.00% | 0.01% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.01% | 0.01% | 0.02% | 0.01% | 0.01% | 0.01% | 0.01% | 0.01% | 0.03% | 0.03% | 0.04% | 0.04% |

| Batch | Nucle-otide | G | G | C | C | C | A | G | G | T | G | A | A |
|---|---|---|---|---|---|---|---|---|---|---|---|---|---|
| G1333 DddAtox-N-dSpCas9 with spG4 gRNA | A | 0.02% | 0.02% | 0.00% | 0.01% | 0.05% | 99.91% | 0.00% | 0.01% | 0.04% | 0.01% | 99.90% | 99.87% |
| G1333 DddAtox-N-dSpCas9 with spG4 gRNA | T | 0.01% | 0.01% | 0.02% | 0.01% | 0.01% | 0.01% | 0.01% | 0.01% | 99.60% | 0.01% | 0.01% | 0.01% |
| G1333 DddAtox-N-dSpCas9 with spG4 gRNA | C | 0.00% | 0.00% | 99.96% | 99.97% | 99.91% | 0.03% | 0.00% | 0.00% | 0.06% | 0.00% | 0.03% | 0.03% |
| G1333 DddAtox-N-dSpCas9 with spG4 gRNA | G | 99.96% | 99.96% | 0.01% | 0.00% | 0.01% | 0.05% | 99.97% | 99.97% | 0.29% | 99.97% | 0.05% | 0.09% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.01% | 0.01% | 0.01% | 0.01% | 0.01% | 0.01% | 0.01% | 0.01% | 0.01% | 0.01% | 0.01% | 0.01% |
| G1333 DddAtox-C-dSpCas9 with spG4 gRNA | A | 0.01% | 0.01% | 0.01% | 0.00% | 0.02% | 99.86% | 0.00% | 0.01% | 0.02% | 0.01% | 99.90% | 99.84% |
| G1333 DddAtox-C-dSpCas9 with spG4 gRNA | T | 0.01% | 0.02% | 0.04% | 0.02% | 0.01% | 0.01% | 0.02% | 0.01% | 99.58% | 0.01% | 0.01% | 0.01% |
| G1333 DddAtox-C-dSpCas9 with spG4 gRNA | C | 0.01% | 0.00% | 99.63% | 99.94% | 99.93% | 0.04% | 0.00% | 0.01% | 0.09% | 0.00% | 0.04% | 0.03% |
| G1333 DddAtox-C-dSpCas9 with spG4 gRNA | G | 99.66% | 99.66% | 0.01% | 0.00% | 0.00% | 0.06% | 99.95% | 99.95% | 0.28% | 99.95% | 0.03% | 0.09% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.31% | 0.31% | 0.31% | 0.03% | 0.03% | 0.03% | 0.02% | 0.02% | 0.02% | 0.02% | 0.02% | 0.02% |

TABLE 10B-continued

| | | | | | | | | | | | | | |
|---|---|---|---|---|---|---|---|---|---|---|---|---|---|
| dSpCas9 half with spG4 gRNA | | | | | | | | | | | | | |
| G1397 DddAtox-N-dSpCas9 with spG4 gRNA | A | 0.01% | 0.01% | 0.00% | 0.00% | 0.01% | 99.67% | 0.00% | 0.01% | 0.04% | 0.01% | 99.69% | 99.64% |
| G1397 DddAtox-N-dSpCas9 with spG4 gRNA | T | 0.02% | 0.01% | 0.02% | 0.01% | 0.02% | 0.01% | 0.01% | 0.01% | 99.38% | 0.02% | 0.01% | 0.01% |
| G1397 DddAtox-N-dSpCas9 with spG4 gRNA | C | 0.00% | 0.00% | 99.74% | 99.76% | 99.74% | 0.04% | 0.00% | 0.00% | 0.07% | 0.00% | 0.04% | 0.03% |
| G1397 DddAtox-N-dSpCas9 with spG4 gRNA | G | 99.74% | 99.75% | 0.01% | 0.00% | 0.00% | 0.05% | 99.76% | 99.76% | 0.29% | 99.75% | 0.04% | 0.09% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.23% | 0.23% | 0.23% | 0.23% | 0.23% | 0.23% | 0.23% | 0.23% | 0.23% | 0.23% | 0.23% | 0.23% |
| G1397 DddAtox-C-dSpCas9 with spG4 gRNA | A | 0.02% | 0.01% | 0.01% | 0.03% | 0.01% | 99.89% | 0.01% | 0.00% | 0.03% | 0.01% | 99.92% | 99.86% |
| G1397 DddAtox-C-dSpCas9 with spG4 gRNA | T | 0.01% | 0.02% | 0.02% | 0.02% | 0.03% | 0.01% | 0.02% | 0.01% | 99.59% | 0.01% | 0.01% | 0.01% |
| G1397 DddAtox-C-dSpCas9 with spG4 gRNA | C | 0.01% | 0.00% | 99.96% | 99.94% | 99.94% | 0.03% | 0.01% | 0.00% | 0.08% | 0.01% | 0.04% | 0.04% |
| G1397 DddAtox-C-dSpCas9 with spG4 gRNA | G | 99.96% | 99.96% | 0.01% | 0.01% | 0.00% | 0.06% | 99.96% | 99.97% | 0.29% | 99.96% | 0.03% | 0.09% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.01% | 0.01% | 0.01% | 0.01% | 0.01% | 0.01% | 0.01% | 0.01% | 0.01% | 0.01% | 0.00% | 0.01% |

| Batch | Nucle-otide | C | G | T | G | T | G | G | T | T | C | C | A |
|---|---|---|---|---|---|---|---|---|---|---|---|---|---|
| G1333 DddAtox-N-dSpCas9 with spG4 gRNA | A | 0.00% | 0.01% | 0.04% | 0.00% | 0.01% | 0.01% | 0.01% | 0.00% | 0.01% | 0.01% | 0.01% | 99.94% |
| G1333 DddAtox-N-dSpCas9 with spG4 gRNA | T | 0.01% | 0.01% | 99.57% | 0.02% | 99.89% | 0.02% | 0.01% | 99.94% | 99.96% | 0.01% | 0.02% | 0.01% |
| G1333 DddAtox-N-dSpCas9 with spG4 gRNA | C | 0.00% | 0.00% | 0.06% | 0.00% | 0.03% | 0.00% | 0.00% | 0.03% | 0.01% | 99.97% | 99.95% | 0.02% |
| G1333 DddAtox-N-dSpCas9 with spG4 gRNA | G | 99.98% | 99.97% | 0.33% | 99.97% | 0.06% | 99.96% | 99.97% | 0.02% | 0.00% | 0.00% | 0.01% | 0.03% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.01% | 0.01% | 0.01% | 0.01% | 0.00% | 0.00% | 0.01% | 0.00% | 0.01% | 0.00% | 0.01% | 0.00% |

TABLE 10B-continued

| dSpCas9 half with spG4 gRNA | | | | | | | | | | | | | |
|---|---|---|---|---|---|---|---|---|---|---|---|---|---|
| G1333 DddAtox-C-dSpCas9 with spG4 gRNA | A | 0.00% | 0.00% | 0.02% | 0.01% | 0.01% | 0.01% | 0.00% | 0.01% | 0.01% | 0.00% | 0.01% | 99.94% |
| G1333 DddAtox-C-dSpCas9 with spG4 gRNA | T | 0.02% | 0.02% | 99.49% | 0.02% | 99.87% | 0.02% | 0.02% | 99.91% | 99.94% | 0.01% | 0.01% | 0.01% |
| G1333 DddAtox-C-dSpCas9 with spG4 gRNA | C | 0.00% | 0.00% | 0.11% | 0.00% | 0.03% | 0.01% | 0.00% | 0.04% | 0.03% | 99.98% | 99.96% | 0.00% |
| G1333 DddAtox-C-dSpCas9 with spG4 gRNA | G | 99.95% | 99.96% | 0.36% | 99.96% | 0.08% | 99.95% | 99.96% | 0.02% | 0.00% | 0.00% | 0.01% | 0.04% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.02% | 0.02% | 0.02% | 0.02% | 0.02% | 0.01% | 0.01% | 0.01% | 0.02% | 0.01% | 0.02% | 0.01% |
| G1397 DddAtox-N-dSpCas9 with spG4 gRNA | A | 0.01% | 0.00% | 0.04% | 0.01% | 0.02% | 0.01% | 0.00% | 0.01% | 0.00% | 0.00% | 0.01% | 99.95% |
| G1397 DddAtox-N-dSpCas9 with spG4 gRNA | T | 0.01% | 0.01% | 99.37% | 0.02% | 99.65% | 0.02% | 0.01% | 99.94% | 99.97% | 0.01% | 0.01% | 0.01% |
| G1397 DddAtox-N-dSpCas9 with spG4 gRNA | C | 0.00% | 0.00% | 0.07% | 0.00% | 0.03% | 0.00% | 0.00% | 0.03% | 0.02% | 99.98% | 99.98% | 0.01% |
| G1397 DddAtox-N-dSpCas9 with spG4 gRNA | G | 99.75% | 99.76% | 0.29% | 99.75% | 0.07% | 99.75% | 99.99% | 0.02% | 0.00% | 0.00% | 0.00% | 0.03% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.23% | 0.23% | 0.23% | 0.23% | 0.23% | 0.23% | 0.00% | 0.00% | 0.00% | 0.00% | 0.00% | 0.00% |
| G1397 DddAtox-C-dSpCas9 with spG4 gRNA | A | 0.01% | 0.00% | 0.04% | 0.00% | 0.01% | 0.00% | 0.01% | 0.01% | 0.01% | 0.00% | 0.01% | 99.95% |
| G1397 DddAtox-C-dSpCas9 with spG4 gRNA | T | 0.01% | 0.02% | 99.59% | 0.03% | 99.89% | 0.02% | 0.01% | 99.95% | 99.96% | 0.02% | 0.01% | 0.01% |
| G1397 DddAtox-C-dSpCas9 with spG4 gRNA | C | 0.01% | 0.00% | 0.07% | 0.01% | 0.03% | 0.00% | 0.01% | 0.02% | 0.02% | 99.97% | 99.97% | 0.01% |
| G1397 DddAtox-C-dSpCas9 with spG4 gRNA | G | 99.97% | 99.98% | 0.30% | 99.96% | 0.07% | 99.98% | 99.98% | 0.02% | 0.00% | 0.01% | 0.00% | 0.03% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.01% | 0.00% |

TABLE 10B-continued

| dSpCas9 half with spG4 gRNA | | | | | | | | | | | | | |
|---|---|---|---|---|---|---|---|---|---|---|---|---|---|
| Batch | Nucle-otide | G | A | A | C | C | G | G | A | G | G | A | C |
| G1333 DddAtox-N-dSpCas9 with spG4 gRNA | A | 0.01% | 99.97% | 99.96% | 0.01% | 0.00% | 0.01% | 0.01% | 99.92% | 0.00% | 0.01% | 99.90% | 0.00% |
| G1333 DddAtox-N-dSpCas9 with spG4 gRNA | T | 0.01% | 0.00% | 0.00% | 0.01% | 0.01% | 0.01% | 0.01% | 0.01% | 0.01% | 0.02% | 0.02% | 0.01% |
| G1333 DddAtox-N-dSpCas9 with spG4 gRNA | C | 0.00% | 0.01% | 0.02% | 99.98% | 99.97% | 0.00% | 0.00% | 0.01% | 0.00% | 0.00% | 0.06% | 99.99% |
| G1333 DddAtox-N-dSpCas9 with spG4 gRNA | G | 99.97% | 0.01% | 0.01% | 0.00% | 0.01% | 99.97% | 99.98% | 0.06% | 99.98% | 99.97% | 0.03% | 0.00% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | A | 0.01% | 99.97% | 99.96% | 0.01% | 0.00% | 0.01% | 0.01% | 99.88% | 0.00% | 0.01% | 99.88% | 0.01% |
| G1333 DddAtox-C-dSpCas9 with spG4 gRNA | T | 0.01% | 0.01% | 0.01% | 0.01% | 0.02% | 0.00% | 0.01% | 0.01% | 0.02% | 0.01% | 0.02% | 0.00% |
| G1333 DddAtox-C-dSpCas9 with spG4 gRNA | C | 0.01% | 0.01% | 0.02% | 99.97% | 99.96% | 0.01% | 0.00% | 0.03% | 0.00% | 0.00% | 0.07% | 99.98% |
| G1333 DddAtox-C-dSpCas9 with spG4 gRNA | G | 99.97% | 0.01% | 0.01% | 0.00% | 0.01% | 99.97% | 99.97% | 0.07% | 99.97% | 99.97% | 0.03% | 0.00% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.01% | 0.01% | 0.01% | 0.01% | 0.01% | 0.00% | 0.01% | 0.01% | 0.00% | 0.00% | 0.00% | 0.00% |
| G1397 DddAtox-N-dSpCas9 with spG4 gRNA | A | 0.01% | 99.97% | 99.96% | 0.00% | 0.00% | 0.01% | 0.01% | 99.92% | 0.01% | 0.01% | 99.90% | 0.01% |
| G1397 DddAtox-N-dSpCas9 with spG4 gRNA | T | 0.01% | 0.00% | 0.00% | 0.00% | 0.02% | 0.01% | 0.01% | 0.01% | 0.01% | 0.00% | 0.01% | 0.01% |
| G1397 DddAtox-N-dSpCas9 with spG4 gRNA | C | 0.00% | 0.01% | 0.02% | 99.99% | 99.97% | 0.00% | 0.00% | 0.02% | 0.00% | 0.00% | 0.06% | 99.99% |
| G1397 DddAtox-N-dSpCas9 with spG4 gRNA | G | 99.98% | 0.01% | 0.01% | 0.00% | 0.00% | 99.97% | 99.97% | 0.04% | 99.98% | 99.98% | 0.03% | 0.00% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

TABLE 10B-continued

| | | | | | | | | | | | | | |
|---|---|---|---|---|---|---|---|---|---|---|---|---|---|
| dSpCas9 half with spG4 gRNA | | | | | | | | | | | | | |
| G1397 DddAtox-C-dSpCas9 with spG4 gRNA | A | 0.01% | 99.97% | 99.95% | 0.01% | 0.00% | 0.02% | 0.01% | 99.91% | 0.01% | 0.00% | 99.92% | 0.01% |
| G1397 DddAtox-C-dSpCas9 with spG4 gRNA | T | 0.01% | 0.00% | 0.01% | 0.01% | 0.01% | 0.02% | 0.01% | 0.01% | 0.01% | 0.01% | 0.01% | 0.01% |
| G1397 DddAtox-C-dSpCas9 with spG4 gRNA | C | 0.00% | 0.01% | 0.03% | 99.98% | 99.97% | 0.00% | 0.00% | 0.04% | 0.00% | 0.00% | 0.05% | 99.98% |
| G1397 DddAtox-C-dSpCas9 with spG4 gRNA | G | 99.98% | 0.01% | 0.01% | 0.00% | 0.01% | 99.96% | 99.98% | 0.05% | 99.99% | 99.98% | 0.02% | 0.00% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucle-otide | A | A | A | G | T | A | C | A | A | A | C | G |
|---|---|---|---|---|---|---|---|---|---|---|---|---|---|
| G1333 DddAtox-N-dSpCas9 with spG4 gRNA | A | 99.95% | 99.96% | 99.91% | 0.00% | 0.11% | 99.96% | 0.02% | 99.97% | 99.98% | 99.96% | 0.01% | 0.01% |
| G1333 DddAtox-N-dSpCas9 with spG4 gRNA | T | 0.01% | 0.01% | 0.00% | 0.01% | 99.77% | 0.01% | 0.01% | 0.00% | 0.01% | 0.00% | 0.01% | 0.02% |
| G1333 DddAtox-N-dSpCas9 with spG4 gRNA | C | 0.02% | 0.02% | 0.04% | 0.00% | 0.05% | 0.01% | 99.97% | 0.02% | 0.01% | 0.02% | 99.98% | 0.00% |
| G1333 DddAtox-N-dSpCas9 with spG4 gRNA | G | 0.02% | 0.01% | 0.04% | 99.99% | 0.06% | 0.02% | 0.00% | 0.01% | 0.01% | 0.01% | 0.01% | 99.97% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | A | 99.95% | 99.95% | 99.90% | 0.01% | 0.13% | 99.96% | 0.03% | 99.97% | 99.97% | 99.96% | 0.01% | 0.02% |
| G1333 DddAtox-C-dSpCas9 with spG4 gRNA | T | 0.01% | 0.01% | 0.00% | 0.01% | 99.75% | 0.00% | 0.01% | 0.00% | 0.00% | 0.00% | 0.01% | 0.01% |
| G1333 DddAtox-C-dSpCas9 with spG4 gRNA | C | 0.02% | 0.03% | 0.04% | 0.00% | 0.06% | 0.01% | 99.96% | 0.01% | 0.01% | 0.02% | 99.98% | 0.01% |
| G1333 DddAtox-C-dSpCas9 with spG4 gRNA | G | 0.02% | 0.01% | 0.05% | 99.98% | 0.06% | 0.02% | 0.00% | 0.01% | 0.02% | 0.01% | 0.01% | 99.97% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

TABLE 10B-continued

| | | | | | | | | | | | | | |
|---|---|---|---|---|---|---|---|---|---|---|---|---|---|
| dSpCas9 half with spG4 gRNA | | | | | | | | | | | | | |
| G1397 DddAtox-N-dSpCas9 with spG4 gRNA | A | 99.95% | 99.95% | 99.91% | 0.00% | 0.09% | 99.97% | 0.02% | 99.96% | 99.97% | 99.97% | 0.02% | 0.02% |
| G1397 DddAtox-N-dSpCas9 with spG4 gRNA | T | 0.01% | 0.01% | 0.01% | 0.01% | 99.79% | 0.00% | 0.01% | 0.00% | 0.00% | 0.00% | 0.02% | 0.01% |
| G1397 DddAtox-N-dSpCas9 with spG4 gRNA | C | 0.02% | 0.02% | 0.04% | 0.00% | 0.05% | 0.01% | 99.97% | 0.02% | 0.02% | 0.02% | 99.96% | 0.01% |
| G1397 DddAtox-N-dSpCas9 with spG4 gRNA | G | 0.02% | 0.01% | 0.04% | 99.99% | 0.06% | 0.02% | 0.00% | 0.02% | 0.01% | 0.01% | 0.00% | 99.96% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.01% | 0.00% | 0.00% | 0.00% | 0.00% | 0.00% | 0.00% | 0.00% | 0.00% | 0.00% |
| G1397 DddAtox-C-dSpCas9 with spG4 gRNA | A | 99.94% | 99.95% | 99.90% | 0.01% | 0.11% | 99.96% | 0.02% | 99.97% | 99.97% | 99.95% | 0.01% | 0.02% |
| G1397 DddAtox-C-dSpCas9 with spG4 gRNA | T | 0.01% | 0.01% | 0.01% | 0.01% | 99.76% | 0.01% | 0.01% | 0.00% | 0.00% | 0.01% | 0.02% | 0.01% |
| G1397 DddAtox-C-dSpCas9 with spG4 gRNA | C | 0.03% | 0.03% | 0.05% | 0.00% | 0.07% | 0.02% | 99.96% | 0.02% | 0.02% | 0.03% | 99.96% | 0.01% |
| G1397 DddAtox-C-dSpCas9 with spG4 gRNA | G | 0.03% | 0.01% | 0.04% | 99.99% | 0.07% | 0.01% | 0.00% | 0.01% | 0.01% | 0.02% | 0.01% | 99.96% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.01% | 0.00% | 0.00% | 0.00% | 0.00% | 0.00% | 0.00% | 0.00% | 0.00% | 0.00% |

| Batch | Nucleotide | G | C | A | G | A | A | G | C | T | G | G | A |
|---|---|---|---|---|---|---|---|---|---|---|---|---|---|
| G1333 DddAtox-N-dSpCas9 with spG4 gRNA | A | 0.02% | 0.00% | 99.91% | 0.01% | 99.95% | 99.86% | 0.00% | 0.00% | 0.00% | 0.00% | 0.01% | 99.86% |
| G1333 DddAtox-N-dSpCas9 with spG4 gRNA | T | 0.01% | 0.01% | 0.00% | 0.01% | 0.01% | 0.00% | 0.00% | 0.02% | 99.95% | 0.01% | 0.01% | 0.01% |
| G1333 DddAtox-N-dSpCas9 with spG4 gRNA | C | 0.00% | 99.97% | 0.02% | 0.00% | 0.02% | 0.04% | 0.01% | 99.97% | 0.02% | 0.00% | 0.00% | 0.03% |
| G1333 DddAtox-N-dSpCas9 with spG4 gRNA | G | 99.97% | 0.01% | 0.06% | 99.98% | 0.02% | 0.09% | 99.99% | 0.01% | 0.02% | 99.98% | 99.98% | 0.10% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1333 DddAtox-C-dSpCas9 with spG4 gRNA | A | 0.02% | 0.02% | 99.91% | 0.01% | 99.95% | 99.86% | 0.00% | 0.25% | 0.00% | 0.01% | 0.01% | 99.86% |
| G1333 DddAtox-C-dSpCas9 with spG4 gRNA | T | 0.01% | 0.01% | 0.00% | 0.01% | 0.01% | 0.00% | 0.01% | 0.01% | 99.95% | 0.01% | 0.01% | 0.01% |
| G1333 DddAtox-C-dSpCas9 with spG4 gRNA | C | 0.00% | 99.97% | 0.02% | 0.00% | 0.02% | 0.03% | 0.00% | 99.74% | 0.02% | 0.00% | 0.00% | 0.02% |
| G1333 DddAtox-C-dSpCas9 with spG4 gRNA | G | 99.97% | 0.01% | 0.07% | 99.98% | 0.02% | 0.11% | 99.98% | 0.01% | 0.03% | 99.98% | 99.98% | 0.11% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | A | 0.03% | 0.01% | 99.93% | 0.00% | 99.95% | 99.88% | 0.00% | 0.00% | 0.00% | 0.00% | 0.01% | 99.85% |
| G1397 DddAtox-N-dSpCas9 with spG4 gRNA | T | 0.01% | 0.01% | 0.02% | 0.01% | 0.00% | 0.01% | 0.00% | 0.00% | 99.96% | 0.01% | 0.02% | 0.00% |
| G1397 DddAtox-N-dSpCas9 with spG4 gRNA | C | 0.00% | 99.96% | 0.01% | 0.00% | 0.02% | 0.04% | 0.00% | 99.98% | 0.02% | 0.00% | 0.00% | 0.03% |
| G1397 DddAtox-N-dSpCas9 with spG4 gRNA | G | 99.96% | 0.01% | 0.03% | 99.99% | 0.01% | 0.08% | 99.99% | 0.01% | 0.02% | 99.98% | 99.97% | 0.11% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.00% | 0.00% | 0.00% | 0.00% | 0.00% | 0.00% | 0.00% | 0.00% | 0.01% |
| G1397 DddAtox-C-dSpCas9 with spG4 gRNA | A | 0.02% | 0.01% | 99.92% | 0.00% | 99.95% | 99.87% | 0.00% | 0.01% | 0.01% | 0.00% | 0.01% | 99.84% |
| G1397 DddAtox-C-dSpCas9 with spG4 gRNA | T | 0.01% | 0.01% | 0.01% | 0.01% | 0.00% | 0.00% | 0.01% | 0.01% | 99.95% | 0.01% | 0.01% | 0.01% |
| G1397 DddAtox-C-dSpCas9 with spG4 gRNA | C | 0.00% | 99.96% | 0.02% | 0.00% | 0.03% | 0.03% | 0.00% | 99.98% | 0.02% | 0.00% | 0.01% | 0.05% |
| G1397 DddAtox-C-dSpCas9 with spG4 gRNA | G | 99.96% | 0.02% | 0.04% | 99.99% | 0.02% | 0.09% | 99.98% | 0.01% | 0.02% | 99.98% | 99.97% | 0.10% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| Batch | Nucle-otide | G | G | A | G | G | A | A | G | G | G | C | C |
| G1333 DddAtox-N-dSpCas9 with spG4 gRNA | A | 0.00% | 0.01% | 99.87% | 0.00% | 0.01% | 99.91% | 99.90% | 0.01% | 0.01% | 0.00% | 0.01% | 0.01% |
| G1333 DddAtox-N-dSpCas9 with spG4 gRNA | T | 0.02% | 0.01% | 0.02% | 0.01% | 0.02% | 0.01% | 0.00% | 0.01% | 0.01% | 0.00% | 0.03% | 0.08% |
| G1333 DddAtox-N-dSpCas9 with spG4 gRNA | C | 0.00% | 0.00% | 0.03% | 0.00% | 0.00% | 0.02% | 0.02% | 0.00% | 0.00% | 0.00% | 99.92% | 99.90% |
| G1333 DddAtox-N-dSpCas9 with spG4 gRNA | G | 99.98% | 99.97% | 0.08% | 99.98% | 99.96% | 0.05% | 0.07% | 99.98% | 99.98% | 99.99% | 0.03% | 0.01% |
| G1333 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.00% | 0.00% | 0.01% | 0.01% | 0.00% | 0.00% | 0.00% | 0.00% | 0.00% |
| G1333 DddAtox-C-dSpCas9 with spG4 gRNA | A | 0.00% | 0.00% | 99.86% | 0.00% | 0.01% | 99.93% | 99.89% | 0.01% | 0.01% | 0.01% | 0.02% | 0.02% |
| G1333 DddAtox-C-dSpCas9 with spG4 gRNA | T | 0.01% | 0.01% | 0.00% | 0.01% | 0.01% | 0.01% | 0.01% | 0.01% | 0.00% | 0.01% | 0.03% | 0.08% |
| G1333 DddAtox-C-dSpCas9 with spG4 gRNA | C | 0.00% | 0.00% | 0.04% | 0.00% | 0.00% | 0.02% | 0.01% | 0.00% | 0.00% | 0.01% | 99.91% | 99.88% |
| G1333 DddAtox-C-dSpCas9 with spG4 gRNA | G | 99.99% | 99.98% | 0.10% | 99.98% | 99.98% | 0.05% | 0.09% | 99.98% | 99.98% | 99.97% | 0.04% | 0.01% |
| G1333 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.01% |
| G1397 DddAtox-N-dSpCas9 with spG4 gRNA | A | 0.00% | 0.00% | 99.88% | 0.01% | 0.01% | 99.91% | 99.91% | 0.01% | 0.01% | 0.00% | 0.02% | 0.03% |
| G1397 DddAtox-N-dSpCas9 with spG4 gRNA | T | 0.02% | 0.01% | 0.02% | 0.01% | 0.01% | 0.01% | 0.01% | 0.01% | 0.01% | 0.01% | 0.04% | 0.06% |
| G1397 DddAtox-N-dSpCas9 with spG4 gRNA | C | 0.00% | 0.00% | 0.04% | 0.00% | 0.00% | 0.03% | 0.03% | 0.00% | 0.00% | 0.00% | 99.90% | 99.89% |
| G1397 DddAtox-N-dSpCas9 with spG4 gRNA | G | 99.97% | 99.98% | 0.06% | 99.97% | 99.98% | 0.05% | 0.05% | 99.97% | 99.98% | 99.98% | 0.03% | 0.02% |
| G1397 DddAtox-N-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.00% | 0.01% | 0.01% | 0.01% | 0.00% | 0.00% | 0.00% | 0.00% | 0.00% | 0.00% |

TABLE 10B-continued

| dSpCas9 half with spG4 gRNA | | | | | | | | | | | | | |
|---|---|---|---|---|---|---|---|---|---|---|---|---|---|
| G1397 DddAtox-C-dSpCas9 with spG4 gRNA | A | 0.01% | 0.00% | 99.84% | 0.01% | 0.01% | 99.94% | 99.91% | 0.01% | 0.01% | 0.01% | 0.02% | 0.02% |
| G1397 DddAtox-C-dSpCas9 with spG4 gRNA | T | 0.02% | 0.01% | 0.01% | 0.01% | 0.01% | 0.01% | 0.01% | 0.01% | 0.01% | 0.01% | 0.02% | 0.07% |
| G1397 DddAtox-C-dSpCas9 with spG4 gRNA | C | 0.00% | 0.00% | 0.05% | 0.00% | 0.00% | 0.01% | 0.02% | 0.00% | 0.00% | 0.00% | 99.92% | 99.88% |
| G1397 DddAtox-C-dSpCas9 with spG4 gRNA | G | 99.97% | 99.98% | 0.09% | 99.97% | 99.97% | 0.03% | 0.07% | 99.97% | 99.98% | 99.98% | 0.04% | 0.02% |
| G1397 DddAtox-C-dSpCas9 with spG4 gRNA | N | 0.00% | 0.00% | 0.00% | 0.00% | 0.00% | 0.00% | 0.00% | 0.00% | 0.00% | 0.00% | 0.00% | 0.00% |
| G1397 DddAtox-C-dSpCas9 with spG4 gRNA | — | 0.00% | 0.00% | 0.00% | 0.00% | 0.00% | 0.00% | 0.00% | 0.00% | 0.00% | 0.00% | 0.00% | 0.00% |

| Batch | Nucleotide | T | G | A | G | T | C | C | G |
|---|---|---|---|---|---|---|---|---|---|
| G1333 DddAtox-N-dSpCas9 with spG4 gRNA | A | 0.00% | 0.01% | 99.87% | 0.01% | 0.01% | 0.01% | 0.01% | 0.01% |
| G1333 DddAtox-N-dSpCas9 with spG4 gRNA | T | 99.91% | 0.01% | 0.00% | 0.00% | 99.84% | 0.03% | 0.04% | 0.01% |
| G1333 DddAtox-N-dSpCas9 with spG4 gRNA | C | 0.05% | 0.00% | 0.03% | 0.00% | 0.05% | 99.96% | 99.86% | 0.00% |
| G1333 DddAtox-N-dSpCas9 with spG4 gRNA | G | 0.04% | 99.97% | 0.08% | 99.97% | 0.05% | 0.00% | 0.01% | 99.93% |
| G1333 DddAtox-N-dSpCas9 with spG4 gRNA | N | 0.00% | 0.00% | 0.00% | 0.00% | 0.00% | 0.00% | 0.00% | 0.00% |
| G1333 DddAtox-N-dSpCas9 with spG4 gRNA | — | 0.00% | 0.00% | 0.00% | 0.01% | 0.05% | 0.00% | 0.08% | 0.05% |
| G1333 DddAtox-C-dSpCas9 with spG4 gRNA | A | 0.01% | 0.03% | 99.89% | 0.01% | 0.01% | 0.03% | 0.01% | 0.02% |
| G1333 DddAtox-C-dSpCas9 with spG4 gRNA | T | 99.90% | 0.01% | 0.01% | 0.02% | 99.81% | 0.03% | 0.05% | 0.01% |
| G1333 DddAtox-C-dSpCas9 with spG4 gRNA | C | 0.04% | 0.00% | 0.02% | 0.00% | 0.09% | 99.93% | 99.82% | 0.01% |
| G1333 DddAtox-C-dSpCas9 with spG4 gRNA | G | 0.04% | 99.96% | 0.07% | 99.96% | 0.06% | 0.01% | 0.02% | 99.90% |
| G1333 DddAtox-C-dSpCas9 with spG4 gRNA | N | 0.00% | 0.00% | 0.00% | 0.00% | 0.00% | 0.00% | 0.00% | 0.00% |
| G1333 DddAtox-C-dSpCas9 with spG4 gRNA | — | 0.00% | 0.00% | 0.00% | 0.02% | 0.03% | 0.00% | 0.10% | 0.07% |
| G1397 DddAtox-N-dSpCas9 with spG4 gRNA | A | 0.01% | 0.01% | 99.86% | 0.00% | 0.02% | 0.01% | 0.01% | 0.01% |
| G1397 DddAtox-N-dSpCas9 with spG4 gRNA | T | 99.91% | 0.02% | 0.01% | 0.01% | 99.81% | 0.05% | 0.05% | 0.01% |
| G1397 DddAtox-N-dSpCas9 with spG4 gRNA | C | 0.04% | 0.00% | 0.03% | 0.00% | 0.07% | 99.93% | 99.86% | 0.00% |
| G1397 DddAtox-N-dSpCas9 with spG4 gRNA | G | 0.04% | 99.96% | 0.09% | 99.95% | 0.05% | 0.01% | 0.01% | 99.89% |
| G1397 DddAtox-N-dSpCas9 with spG4 gRNA | N | 0.00% | 0.00% | 0.00% | 0.00% | 0.00% | 0.00% | 0.00% | 0.00% |
| G1397 DddAtox-N-dSpCas9 with spG4 gRNA | — | 0.00% | 0.00% | 0.01% | 0.03% | 0.05% | 0.00% | 0.08% | 0.08% |
| G1397 DddAtox-C-dSpCas9 with spG4 gRNA | A | 0.01% | 0.01% | 99.86% | 0.01% | 0.03% | 0.01% | 0.00% | 0.01% |
| G1397 DddAtox-C-dSpCas9 with spG4 gRNA | T | 99.89% | 0.02% | 0.01% | 0.01% | 99.82% | 0.04% | 0.05% | 0.01% |
| G1397 DddAtox-C-dSpCas9 with spG4 gRNA | C | 0.05% | 0.00% | 0.04% | 0.00% | 0.07% | 99.93% | 99.85% | 0.00% |
| G1397 DddAtox-C-dSpCas9 with spG4 gRNA | G | 0.04% | 99.97% | 0.09% | 99.95% | 0.05% | 0.01% | 0.01% | 99.89% |
| G1397 DddAtox-C-dSpCas9 with spG4 gRNA | N | 0.00% | 0.00% | 0.00% | 0.00% | 0.00% | 0.00% | 0.00% | 0.00% |
| G1397 DddAtox-C-dSpCas9 with spG4 gRNA | — | 0.01% | 0.00% | 0.01% | 0.03% | 0.05% | 0.00% | 0.09% | 0.08% |

TABLE 10B-continued

| dSpCas9 half with spG4 gRNA | | | | | | | | | |
|---|---|---|---|---|---|---|---|---|---|
| Batch | Nucleotide | A | G | C | A | G | A | A | G |
| G1333 DddAtox-N-dSpCas9 with spG4 gRNA | A | 99.88% | 0.01% | 0.03% | 1.92% | 0.07% | 1.81% | 0.03% | 0.00% |
| G1333 DddAtox-N-dSpCas9 with spG4 gRNA | T | 0.01% | 0.01% | 0.03% | 0.01% | 0.01% | 0.01% | 0.00% | 0.00% |
| G1333 DddAtox-N-dSpCas9 with spG4 gRNA | C | 0.02% | 0.00% | 99.90% | 0.04% | 0.00% | 0.01% | 0.00% | 0.00% |
| G1333 DddAtox-N-dSpCas9 with spG4 gRNA | G | 0.07% | 99.94% | 0.02% | 0.09% | 1.97% | 0.04% | 0.00% | 0.03% |
| G1333 DddAtox-N-dSpCas9 with spG4 gRNA | N | 0.00% | 0.00% | 0.00% | 0.00% | 0.00% | 0.00% | 0.00% | 0.00% |
| G1333 DddAtox-N-dSpCas9 with spG4 gRNA | — | 0.02% | 0.04% | 0.03% | 97.94% | 97.96% | 98.13% | 99.97% | 99.97% |
| G1333 DddAtox-C-dSpCas9 with spG4 gRNA | A | 99.86% | 0.01% | 0.02% | 2.35 | 0.09% | 2.23 | 0.34 | 0.00% |
| G1333 DddAtox-C-dSpCas9 with spG4 gRNA | T | 0.01% | 0.00% | 0.05% | 0.01% | 0.00% | 0.01% | 0.00% | 0.00% |
| G1333 DddAtox-C-dSpCas9 with spG4 gRNA | C | 0.02% | 0.00% | 99.89% | 0.06% | 0.00% | 0.00% | 0.00% | 0.00% |
| G1333 DddAtox-C-dSpCas9 with spG4 gRNA | G | 0.08% | 99.96% | 0.02% | 0.11% | 2.39% | 0.04% | 0.00% | 0.34% |
| G1333 DddAtox-C-dSpCas9 with spG4 gRNA | N | 0.00% | 0.00% | 0.00% | 0.00% | 0.00% | 0.00% | 0.00% | 0.00% |
| G1333 DddAtox-C-dSpCas9 with spG4 gRNA | — | 0.03% | 0.03% | 0.02% | 97.48% | 97.52% | 97.72% | 99.66% | 99.66% |
| G1397 DddAtox-N-dSpCas9 with spG4 gRNA | A | 99.87% | 0.01% | 0.02% | 2.42% | 0.10% | 2.29% | 0.25% | 0.00% |
| G1397 DddAtox-N-dSpCas9 with spG4 gRNA | T | 0.01% | 0.00% | 0.04% | 0.01% | 0.00% | 0.01% | 0.00% | 0.00% |
| G1397 DddAtox-N-dSpCas9 with spG4 gRNA | C | 0.02% | 0.01% | 99.90% | 0.06% | 0.00% | 0.01% | 0.00% | 0.00% |
| G1397 DddAtox-N-dSpCas9 with spG4 gRNA | G | 0.08% | 99.94% | 0.02% | 0.09% | 2.46% | 0.06% | 0.00% | 0.25% |
| G1397 DddAtox-N-dSpCas9 with spG4 gRNA | N | 0.00% | 0.00% | 0.00% | 0.00% | 0.00% | 0.00% | 0.00% | 0.00% |
| G1397 DddAtox-N-dSpCas9 with spG4 gRNA | — | 0.03% | 0.04% | 0.02% | 97.42% | 97.44% | 97.64% | 99.75% | 99.75% |
| G1397 DddAtox-C-dSpCas9 with spG4 gRNA | A | 99.86% | 0.01% | 0.03% | 2.19% | 0.10% | 2.05% | 0.04% | 0.00% |
| G1397 DddAtox-C-dSpCas9 with spG4 gRNA | T | 0.01% | 0.01% | 0.04% | 0.01% | 0.01% | 0.00% | 0.00% | 0.00% |
| G1397 DddAtox-C-dSpCas9 with spG4 gRNA | C | 0.03% | 0.01% | 99.88% | 0.04% | 0.00% | 0.01% | 0.00% | 0.00% |
| G1397 DddAtox-C-dSpCas9 with spG4 gRNA | G | 0.06% | 99.93% | 0.03% | 0.10% | 2.20% | 0.04% | 0.00% | 0.04% |
| G1397 DddAtox-C-dSpCas9 with spG4 gRNA | N | 0.00% | 0.00% | 0.00% | 0.00% | 0.00% | 0.00% | 0.00% | 0.00% |
| G1397 DddAtox-C-dSpCas9 with spG4 gRNA | — | 0.03% | 0.04% | 0.02% | 97.66% | 97.69% | 97.90% | 99.95% | 99.96% |

TABLE 10C

| No gRNA | | | | | | | | | | | | | |
|---|---|---|---|---|---|---|---|---|---|---|---|---|---|
| Batch | Nucle-otide | G | G | C | C | C | C | T | A | A | C | C | C |
| nogRNA-A1343spilt-KKH-Cas9-A1343-N and dSpCas9-A1343-C | A | 0.23% | 0.03% | 0.01% | 0.00% | 0.00% | 0.02% | 0.00% | 99.89% | 99.60% | 0.00% | 0.00% | 0.01% |
| nogRNA-A1343spilt-KKH-Cas9-A1343-N and dSpCas9-A1343-C | T | 0.25% | 0.04% | 0.01% | 0.01% | 0.01% | 0.00% | 99.89% | 0.02% | 0.01% | 0.00% | 0.00% | 0.00% |
| nogRNA-A1343spilt-KKH-Cas9-A1343-N and dSpCas9-A1343-C | C | 0.18% | 0.01% | 99.17% | 99.97% | 99.98% | 99.97% | 0.06% | 0.03% | 0.00% | 100.00% | 99.98% | 99.72% |
| nogRNA-A1343spilt-KKH-Cas9-A1343-N and dSpCas9-A1343-C | G | 99.34% | 99.92% | 0.80% | 0.01% | 0.00% | 0.00% | 0.00% | 0.05% | 0.04% | 0.00% | 0.00% | 0.00% |

TABLE 10C-continued

| No gRNA | | | | | | | | | | | | | |
|---|---|---|---|---|---|---|---|---|---|---|---|---|---|
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.05% | 0.00% | 0.34% | 0.00% | 0.01% | 0.27% |
| nogRNA-A1343spilt-KKH-Cas9-A1343-C and dSpCas9-A1343-N | A | 0.25% | 0.04% | 0.01% | 0.00% | 0.00% | 0.00% | 0.00% | 99.92% | 99.56% | 0.01% | 0.00% | 0.01% |
| nogRNA-A1343spilt-KKH-Cas9-A1343-C and dSpCas9-A1343-N | T | 0.27% | 0.03% | 0.00% | 0.01% | 0.01% | 0.00% | 99.93% | 0.00% | 0.00% | 0.01% | 0.02% | 0.00% |
| nogRNA-A1343spilt-KKH-Cas9-A1343-C and dSpCas9-A1343-N | C | 0.15% | 0.03% | 99.10% | 99.98% | 99.98% | 99.99% | 0.01% | 0.05% | 0.03% | 99.96% | 99.97% | 99.69% |
| nogRNA-A1343spilt-KKH-Cas9-A1343-C and dSpCas9-A1343-N | G | 99.33% | 99.90% | 0.89% | 0.00% | 0.00% | 0.00% | 0.00% | 0.04% | 0.02% | 0.00% | 0.00% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.05% | 0.00% | 0.39% | 0.01% | 0.00% | 0.29% |
| nogRNA-G1322spilt-KKH-Cas9-G1322-N and dSpCas9-G1322-C | A | 0.21% | 0.05% | 0.02% | 0.00% | 0.01% | 0.01% | 0.00% | 99.94% | 99.59% | 0.00% | 0.00% | 0.01% |
| nogRNA-G1322spilt-KKH-Cas9-G1322-N and dSpCas9-G1322-C | T | 0.25% | 0.01% | 0.01% | 0.01% | 0.01% | 0.00% | 99.90% | 0.01% | 0.01% | 0.01% | 0.01% | 0.01% |
| nogRNA-G1322spilt-KKH-Cas9-G1322-N and dSpCas9-G1322-C | C | 0.14% | 0.02% | 99.18% | 99.98% | 99.96% | 99.97% | 0.04% | 0.02% | 0.02% | 99.98% | 99.97% | 99.74% |
| nogRNA-G1322spilt-KKH-Cas9-G1322-N and dSpCas9-G1322-C | G | 99.40% | 99.91% | 0.79% | 0.01% | 0.00% | 0.00% | 0.00% | 0.02% | 0.02% | 0.00% | 0.00% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.01% | 0.02% | 0.05% | 0.01% | 0.37% | 0.01% | 0.01% | 0.24% |
| nogRNA-G1322spilt-KKH-Cas9-G1322-C and dSpCas9-G1322-N | A | 0.24% | 0.03% | 0.00% | 0.00% | 0.00% | 0.02% | 0.00% | 99.90% | 99.57% | 0.01% | 0.00% | 0.00% |
| nogRNA-G1322spilt-KKH-Cas9-G1322-C and dSpCas9-G1322-N | T | 0.27% | 0.03% | 0.01% | 0.00% | 0.00% | 0.02% | 99.93% | 0.00% | 0.01% | 0.00% | 0.00% | 0.00% |
| nogRNA-G1322spilt-KKH-Cas9-G1322-C and dSpCas9-G1322-N | C | 0.14% | 0.01% | 99.11% | 99.97% | 99.99% | 99.96% | 0.02% | 0.03% | 0.01% | 99.98% | 99.99% | 99.73% |
| nogRNA-G1322spilt-KKH-Cas9-G1322-C and dSpCas9-G1322-N | G | 99.35% | 99.92% | 0.87% | 0.03% | 0.00% | 0.01% | 0.00% | 0.06% | 0.03% | 0.00% | 0.00% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% | 0.00% | 0.00% | 0.00% |

TABLE 10C-continued

| No gRNA | | | | | | | | | | | | | |
|---|---|---|---|---|---|---|---|---|---|---|---|---|---|
| nogRNA-G1322spilt-KKH-Cas9-G1322-C and dSpCas9-G1322-N | — | 0.00% | 0.00% | 0.00% | 0.00% | 0.00% | 0.00% | 0.04% | 0.01% | 0.38% | 0.00% | 0.01% | 0.27% |
| nogRNA-G1333spilt-KKH-Cas9-G1333-N and dSpCas9-G1333-C | A | 0.27% | 0.03% | 0.01% | 0.00% | 0.01% | 0.00% | 0.00% | 99.89% | 99.56% | 0.01% | 0.01% | 0.00% |
| nogRNA-G1333spilt-KKH-Cas9-G1333-N and dSpCas9-G1333-C | T | 0.28% | 0.01% | 0.00% | 0.01% | 0.01% | 0.01% | 99.93% | 0.00% | 0.00% | 0.00% | 0.01% | 0.00% |
| nogRNA-G1333spilt-KKH-Cas9-G1333-N and dSpCas9-G1333-C | C | 0.19% | 0.02% | 99.00% | 99.97% | 99.97% | 99.96% | 0.02% | 0.03% | 0.01% | 99.97% | 99.96% | 99.65% |
| nogRNA-G1333spilt-KKH-Cas9-G1333-N and dSpCas9-G1333-C | G | 99.25% | 99.93% | 0.98% | 0.01% | 0.00% | 0.01% | 0.01% | 0.07% | 0.03% | 0.00% | 0.00% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.01% | 0.00% | 0.00% | 0.00% | 0.01% | 0.02% | 0.05% | 0.00% | 0.40% | 0.01% | 0.02% | 0.34% |
| nogRNA-G1333spilt-KKH-Cas9-G1333-C and dSpCas9-G1333-N | A | 0.20% | 0.03% | 0.02% | 0.00% | 0.00% | 0.00% | 0.01% | 99.93% | 99.52% | 0.00% | 0.01% | 0.00% |
| nogRNA-G1333spilt-KKH-Cas9-G1333-C and dSpCas9-G1333-N | T | 0.35% | 0.02% | 0.00% | 0.01% | 0.00% | 0.01% | 99.90% | 0.01% | 0.00% | 0.00% | 0.02% | 0.01% |
| nogRNA-G1333spilt-KKH-Cas9-G1333-C and dSpCas9-G1333-N | C | 0.19% | 0.03% | 99.03% | 99.96% | 99.95% | 99.95% | 0.05% | 0.03% | 0.03% | 99.98% | 99.95% | 99.72% |
| nogRNA-G1333spilt-KKH-Cas9-G1333-C and dSpCas9-G1333-N | G | 99.26% | 99.92% | 0.95% | 0.02% | 0.01% | 0.00% | 0.00% | 0.02% | 0.01% | 0.00% | 0.00% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.04% | 0.04% | 0.04% | 0.01% | 0.44% | 0.02% | 0.02% | 0.26% |
| nogRNA-G1371spilt-KKH-Cas9-G1371-N and dSpCas9-G1371-C | A | 0.18% | 0.05% | 0.02% | 0.01% | 0.01% | 0.01% | 0.00% | 99.93% | 99.62% | 0.00% | 0.00% | 0.00% |
| nogRNA-G1371spilt-KKH-Cas9-G1371-N and dSpCas9-G1371-C | T | 0.24% | 0.03% | 0.01% | 0.02% | 0.00% | 0.00% | 99.95% | 0.01% | 0.00% | 0.01% | 0.02% | 0.02% |
| nogRNA-G1371spilt-KKH-Cas9-G1371-N and dSpCas9-G1371-C | C | 0.16% | 0.02% | 99.25% | 99.96% | 99.98% | 99.97% | 0.02% | 0.01% | 0.01% | 99.97% | 99.98% | 99.66% |
| nogRNA-G1371spilt-KKH-Cas9-G1371-N and dSpCas9-G1371-C | G | 99.42% | 99.90% | 0.71% | 0.01% | 0.00% | 0.00% | 0.00% | 0.04% | 0.01% | 0.00% | 0.00% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.01% | 0.01% | 0.03% | 0.01% | 0.36% | 0.02% | 0.00% | 0.33% |

TABLE 10C-continued

| No gRNA | | | | | | | | | | | | | |
|---|---|---|---|---|---|---|---|---|---|---|---|---|---|
| nogRNA-G1371spilt-KKH-Cas9-G1371-C and dSpCas9-G1371-N | A | 0.20% | 0.06% | 0.00% | 0.00% | 0.01% | 0.00% | 0.00% | 99.92% | 99.61% | 0.01% | 0.00% | 0.00% |
| nogRNA-G1371spilt-KKH-Cas9-G1371-C and dSpCas9-G1371-N | T | 0.28% | 0.03% | 0.02% | 0.02% | 0.01% | 0.00% | 99.93% | 0.00% | 0.01% | 0.01% | 0.00% | 0.01% |
| nogRNA-G1371spilt-KKH-Cas9-G1371-C and dSpCas9-G1371-N | C | 0.16% | 0.02% | 99.09% | 99.96% | 99.97% | 99.98% | 0.02% | 0.02% | 0.01% | 99.96% | 99.98% | 99.70% |
| nogRNA-G1371spilt-KKH-Cas9-G1371-C and dSpCas9-G1371-N | G | 99.35% | 99.89% | 0.89% | 0.01% | 0.00% | 0.00% | 0.02% | 0.05% | 0.02% | 0.00% | 0.01% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.01% | 0.01% | 0.03% | 0.00% | 0.35% | 0.01% | 0.01% | 0.29% |
| nogRNA-G1397spilt-KKH-Cas9-G1397-N and dSpCas9-G1397-C | A | 0.22% | 0.06% | 0.01% | 0.01% | 0.00% | 0.00% | 0.00% | 99.88% | 99.58% | 0.01% | 0.00% | 0.00% |
| nogRNA-G1397spilt-KKH-Cas9-G1397-N and dSpCas9-G1397-C | T | 0.26% | 0.01% | 0.01% | 0.00% | 0.00% | 0.00% | 99.92% | 0.01% | 0.01% | 0.00% | 0.00% | 0.00% |
| nogRNA-G1397spilt-KKH-Cas9-G1397-N and dSpCas9-G1397-C | C | 0.19% | 0.03% | 99.10% | 99.97% | 99.98% | 99.98% | 0.03% | 0.05% | 0.01% | 99.98% | 99.98% | 99.74% |
| nogRNA-G1397spilt-KKH-Cas9-G1397-N and dSpCas9-G1397-C | G | 99.31% | 99.90% | 0.87% | 0.02% | 0.00% | 0.00% | 0.00% | 0.06% | 0.02% | 0.00% | 0.00% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.01% | 0.00% | 0.00% | 0.00% | 0.01% | 0.01% | 0.05% | 0.01% | 0.38% | 0.01% | 0.01% | 0.25% |
| nogRNA-G1397spilt-KKH-Cas9-G1397-C and dSpCas9-G1397-N | A | 0.27% | 0.04% | 0.01% | 0.00% | 0.01% | 0.01% | 0.01% | 99.92% | 99.56% | 0.00% | 0.00% | 0.01% |
| nogRNA-G1397spilt-KKH-Cas9-G1397-C and dSpCas9-G1397-N | T | 0.29% | 0.02% | 0.01% | 0.01% | 0.01% | 0.00% | 99.92% | 0.01% | 0.01% | 0.01% | 0.02% | 0.00% |
| nogRNA-G1397spilt-KKH-Cas9-G1397-C and dSpCas9-G1397-N | C | 0.15% | 0.03% | 98.97% | 99.96% | 99.98% | 99.98% | 0.02% | 0.02% | 0.01% | 99.96% | 99.97% | 99.76% |
| nogRNA-G1397spilt-KKH-Cas9-G1397-C and dSpCas9-G1397-N | G | 99.29% | 99.90% | 1.01% | 0.03% | 0.00% | 0.00% | 0.00% | 0.03% | 0.03% | 0.00% | 0.00% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.01% | 0.01% | 0.05% | 0.02% | 0.39% | 0.02% | 0.01% | 0.23% |
| nogRNA-N1357spilt-KKH-Cas9-N1357-N and dSpCas9-N1357-C | A | 0.26% | 0.04% | 0.01% | 0.00% | 0.00% | 0.01% | 0.00% | 99.93% | 99.59% | 0.01% | 0.00% | 0.01% |

TABLE 10C-continued

| | | No gRNA | | | | | | | | | | | |
|---|---|---|---|---|---|---|---|---|---|---|---|---|---|
| nogRNA-N1357spilt-KKH-Cas9-N1357-N and dSpCas9-N1357-C | T | 0.32% | 0.02% | 0.01% | 0.01% | 0.02% | 0.01% | 99.94% | 0.00% | 0.00% | 0.01% | 0.01% | 0.00% |
| nogRNA-N1357spilt-KKH-Cas9-N1357-N and dSpCas9-N1357-C | C | 0.17% | 0.01% | 99.09% | 99.97% | 99.97% | 99.97% | 0.01% | 0.03% | 0.00% | 99.97% | 99.99% | 99.73% |
| nogRNA-N1357spilt-KKH-Cas9-N1357-N and dSpCas9-N1357-C | G | 99.25% | 99.92% | 0.89% | 0.01% | 0.00% | 0.00% | 0.00% | 0.02% | 0.02% | 0.00% | 0.00% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.01% | 0.01% | 0.05% | 0.01% | 0.38% | 0.01% | 0.00% | 0.27% |
| nogRNA-N1357spilt-KKH-Cas9-N1357-C and dSpCas9-N1357-N | A | 0.22% | 0.03% | 0.03% | 0.01% | 0.00% | 0.00% | 0.01% | 99.85% | 99.57% | 0.00% | 0.01% | 0.00% |
| nogRNA-N1357spilt-KKH-Cas9-N1357-C and dSpCas9-N1357-N | T | 0.23% | 0.02% | 0.01% | 0.01% | 0.00% | 0.00% | 99.94% | 0.01% | 0.01% | 0.00% | 0.01% | 0.01% |
| nogRNA-N1357spilt-KKH-Cas9-N1357-C and dSpCas9-N1357-N | C | 0.19% | 0.03% | 99.18% | 99.96% | 99.97% | 99.98% | 0.02% | 0.05% | 0.03% | 99.99% | 99.98% | 99.76% |
| nogRNA-N1357spilt-KKH-Cas9-N1357-C and dSpCas9-N1357-N | G | 99.37% | 99.93% | 0.78% | 0.02% | 0.01% | 0.00% | 0.00% | 0.08 | 0.03% | 0.00% | 0.00% | 0.01% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.02% | 0.02% | 0.03% | 0.02% | 0.36% | 0.01% | 0.01% | 0.23% |
| nogRNA-N1387spilt-KKH-Cas9-N1387-N and dSpCas9-N1387-C | A | 0.30% | 0.04% | 0.02% | 0.00% | 0.01% | 0.01% | 0.00% | 99.90% | 99.52% | 0.00% | 0.00% | 0.00% |
| nogRNA-N1387spilt-KKH-Cas9-N1387-N and dSpCas9-N1387-C | T | 0.28% | 0.03% | 0.01% | 0.01% | 0.01% | 0.00% | 99.93% | 0.00% | 0.00% | 0.01% | 0.00% | 0.02% |
| nogRNA-N1387spilt-KKH-Cas9-N1387-N and dSpCas9-N1387-C | C | 0.13% | 0.02% | 99.06% | 99.96% | 99.96% | 99.96% | 0.02% | 0.04% | 0.01% | 99.98% | 99.98% | 99.64% |
| nogRNA-N1387spilt-KKH-Cas9-N1387-N and dSpCas9-N1387-C | G | 99.28% | 99.91% | 0.91% | 0.02% | 0.00% | 0.00% | 0.01% | 0.04% | 0.03% | 0.00% | 0.00% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.01% | 0.03% | 0.04% | 0.01% | 0.44% | 0.01% | 0.01% | 0.33% |
| nogRNA-N1387spilt-KKH-Cas9-N1387-C and dSpCas9-N1387-N | A | 0.26% | 0.04% | 0.01% | 0.01% | 0.01% | 0.01% | 0.00% | 99.90% | 99.56% | 0.01% | 0.00% | 0.00% |
| nogRNA-N1387spilt-KKH-Cas9-N1387-C and dSpCas9-N1387-N | T | 0.28% | 0.02% | 0.01% | 0.02% | 0.01% | 0.02% | 99.94% | 0.00% | 0.01% | 0.00% | 0.01% | 0.00% |

TABLE 10C-continued

| | | | | | | | | | | | | | |
|---|---|---|---|---|---|---|---|---|---|---|---|---|---|
| No gRNA | | | | | | | | | | | | | |
| nogRNA-N1387spilt-KKH-Cas9-N1387-C and dSpCas9-N1387-N | C | 0.20% | 0.03% | 99.09% | 99.96% | 99.96% | 99.94% | 0.02% | 0.04% | 0.01% | 99.99% | 99.99% | 99.80% |
| nogRNA-N1387spilt-KKH-Cas9-N1387-C and dSpCas9-N1387-N | G | 99.25% | 99.90% | 0.89% | 0.02% | 0.00% | 0.00% | 0.00% | 0.05% | 0.01% | 0.00% | 0.00% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.02% | 0.03% | 0.03% | 0.00% | 0.40% | 0.00% | 0.00% | 0.20% |
| Batch | Nucleotide | T | A | T | G | T | A | G | C | C | T | C | A |
| nogRNA-A1343spilt-KKH-Cas9-A1343-N and dSpCas9-A1343-C | A | 0.01% | 99.89% | 0.00% | 0.04% | 0.00% | 99.94% | 0.03% | 0.01% | 0.00% | 0.00% | 0.00% | 99.96% |
| nogRNA-A1343spilt-KKH-Cas9-A1343-N and dSpCas9-A1343-C | T | 99.94% | 0.00% | 99.98% | 0.02% | 99.98% | 0.00% | 0.03% | 0.02% | 0.01% | 99.99% | 0.02% | 0.00% |
| nogRNA-A1343spilt-KKH-Cas9-A1343-N and dSpCas9-A1343-C | C | 0.00% | 0.01% | 0.01% | 0.00% | 0.01% | 0.03% | 0.00% | 99.97% | 99.99% | 0.00% | 99.96% | 0.03% |
| nogRNA-A1343spilt-KKH-Cas9-A1343-N and dSpCas9-A1343-C | G | 0.00% | 0.05% | 0.00% | 99.93% | 0.00% | 0.02% | 99.93% | 0.00% | 0.00% | 0.00% | 0.01% | 0.01% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.05% | 0.05% | 0.00% | 0.01% | 0.01% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 99.86% | 0.02% | 0.04% | 0.01% | 99.91% | 0.02% | 0.01% | 0.01% | 0.00% | 0.02% | 99.91% |
| nogRNA-A1343spilt-KKH-Cas9-A1343-C and dSpCas9-A1343-N | T | 99.97% | 0.02% | 99.96% | 0.03% | 99.97% | 0.00% | 0.09% | 0.03% | 0.00% | 99.96% | 0.02% | 0.01% |
| nogRNA-A1343spilt-KKH-Cas9-A1343-C and dSpCas9-A1343-N | C | 0.01% | 0.03% | 0.02% | 0.01% | 0.01% | 0.04% | 0.00% | 99.96% | 99.98% | 0.02% | 99.96% | 0.04% |
| nogRNA-A1343spilt-KKH-Cas9-A1343-C and dSpCas9-A1343-N | G | 0.01% | 0.05% | 0.00% | 99.93% | 0.00% | 0.05% | 99.89 | 0.00% | 0.00% | 0.02% | 0.00% | 0.04% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.01% | 0.05% | 0.00% | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 99.89% | 0.00% | 0.07% | 0.01% | 99.94% | 0.02% | 0.00% | 0.01% | 0.01% | 0.00% | 99.96% |
| nogRNA-G1322spilt-KKH-Cas9-G1322-N and dSpCas9-G1322-C | T | 99.96% | 0.01% | 99.97% | 0.03% | 99.98% | 0.00% | 0.06% | 0.00% | 0.02% | 99.98% | 0.01% | 0.00% |

TABLE 10C-continued

| No gRNA | | | | | | | | | | | | | |
|---|---|---|---|---|---|---|---|---|---|---|---|---|---|
| nogRNA-G1322spilt-KKH-Cas9-G1322-N and dSpCas9-G1322-C | C | 0.01% | 0.01% | 0.02% | 0.00% | 0.01% | 0.01% | 0.00% | 100.00% | 99.97% | 0.01% | 99.99% | 0.02% |
| nogRNA-G1322spilt-KKH-Cas9-G1322-N and dSpCas9-G1322-C | G | 0.00% | 0.03% | 0.00% | 99.89% | 0.00% | 0.04% | 99.92% | 0.00% | 0.00% | 0.00% | 0.00% | 0.02% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.03% | 0.05% | 0.00% | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.01% | 99.88% | 0.00% | 0.08% | 0.01% | 99.93% | 0.02% | 0.00% | 0.00% | 0.00% | 0.00% | 99.95% |
| nogRNA-G1322spilt-KKH-Cas9-G1322-C and dSpCas9-G1322-N | T | 99.94% | 0.02% | 99.97% | 0.03% | 99.96% | 0.03% | 0.07% | 0.00% | 0.01% | 99.97% | 0.03% | 0.00% |
| nogRNA-G1322spilt-KKH-Cas9-G1322-C and dSpCas9-G1322-N | C | 0.00% | 0.03% | 0.02% | 0.01% | 0.02% | 0.02% | 0.00% | 99.99% | 99.99% | 0.01% | 99.96% | 0.03% |
| nogRNA-G1322spilt-KKH-Cas9-G1322-C and dSpCas9-G1322-N | G | 0.01% | 0.05% | 0.00% | 99.88% | 0.00% | 0.02% | 99.91% | 0.00% | 0.00% | 0.01% | 0.00% | 0.02% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.04% | 0.02% | 0.01% | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 99.88% | 0.01% | 0.07% | 0.02% | 99.94% | 0.01 | 0.01% | 0.00% | 0.01% | 0.00% | 99.95% |
| nogRNA-G1333spilt-KKH-Cas9-G1333-N and dSpCas9-G1333-C | T | 99.92% | 0.02% | 99.97% | 0.03% | 99.97% | 0.00% | 0.05% | 0.00% | 0.00% | 99.98% | 0.01% | 0.01% |
| nogRNA-G1333spilt-KKH-Cas9-G1333-N and dSpCas9-G1333-C | C | 0.01% | 0.01% | 0.00% | 0.00% | 0.01% | 0.02% | 0.00% | 99.99% | 99.99% | 0.01% | 99.99% | 0.02% |
| nogRNA-G1333spilt-KKH-Cas9-G1333-N and dSpCas9-G1333-C | G | 0.01% | 0.05% | 0.00% | 99.90% | 0.00% | 0.04% | 99.94% | 0.00% | 0.00% | 0.00% | 0.00% | 0.02% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.06% | 0.04% | 0.01% | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 99.87% | 0.00% | 0.05% | 0.01% | 99.96% | 0.00% | 0.00% | 0.00% | 0.00% | 0.00% | 99.96% |
| nogRNA-G1333spilt-KKH-Cas9-G1333-C and dSpCas9-G1333-N | T | 99.95% | 0.01% | 99.97% | 0.04% | 99.97% | 0.01% | 0.06% | 0.01% | 0.02% | 100.00% | 0.01% | 0.00% |

TABLE 10C-continued

| No gRNA | | | | | | | | | | | | | |
|---|---|---|---|---|---|---|---|---|---|---|---|---|---|
| nogRNA-G1333spilt-KKH-Cas9-G1333-C and dSpCas9-G1333-N | C | 0.00% | 0.01% | 0.00% | 0.00% | 0.01% | 0.01% | 0.00% | 99.99% | 99.98% | 0.00% | 99.98% | 0.02% |
| nogRNA-G1333spilt-KKH-Cas9-G1333-C and dSpCas9-G1333-N | G | 0.00% | 0.05% | 0.00% | 99.90 | 0.00% | 0.02% | 99.94% | 0.00% | 0.00% | 0.00% | 0.00% | 0.02% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.05% | 0.06% | 0.02% | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.01% | 99.89% | 0.00% | 0.05% | 0.01% | 99.95% | 0.02% | 0.01% | 0.01% | 0.01% | 0.01% | 99.96% |
| nogRNA-G1371spilt-KKH-Cas9-G1371-N and dSpCas9-G1371-C | T | 99.93% | 0.02% | 99.96% | 0.03% | 99.95% | 0.00% | 0.04% | 0.01% | 0.01% | 99.98% | 0.02% | 0.01% |
| nogRNA-G1371spilt-KKH-Cas9-G1371-N and dSpCas9-G1371-C | C | 0.02% | 0.00% | 0.01% | 0.00% | 0.03% | 0.01% | 0.00% | 99.98% | 99.98% | 0.01% | 99.97% | 0.01% |
| nogRNA-G1371spilt-KKH-Cas9-G1371-N and dSpCas9-G1371-C | G | 0.00% | 0.06% | 0.00% | 99.92% | 0.00% | 0.03% | 99.94% | 0.00% | 0.00% | 0.00% | 0.00% | 0.02% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.05% | 0.03% | 0.03% | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.00% | 99.87% | 0.00% | 0.05% | 0.01% | 99.95% | 0.01% | 0.00% | 0.00% | 0.01% | 0.00% | 99.93% |
| nogRNA-G1371spilt-KKH-Cas9-G1371-C and dSpCas9-G1371-N | T | 99.96% | 0.03% | 99.96% | 0.05% | 99.96% | 0.01% | 0.06% | 0.00% | 0.01% | 99.97% | 0.03% | 0.01% |
| nogRNA-G1371spilt-KKH-Cas9-G1371-C and dSpCas9-G1371-N | C | 0.00% | 0.01% | 0.01% | 0.01% | 0.02% | 0.01% | 0.00% | 100.00% | 99.99% | 0.01% | 99.96% | 0.03% |
| nogRNA-G1371spilt-KKH-Cas9-G1371-C and dSpCas9-G1371-N | G | 0.01% | 0.06% | 0.01% | 99.89% | 0.00% | 0.03% | 99.92% | 0.00% | 0.00% | 0.01% | 0.00% | 0.02% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.02% | 0.03% | 0.02% | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.01% | 99.86% | 0.00% | 0.07% | 0.01% | 99.94% | 0.01% | 0.00% | 0.00% | 0.01% | 0.00% | 99.93% |
| nogRNA-G1397spilt-KKH-Cas9-G1397-N and dSpCas9-G1397-C | T | 99.96% | 0.01% | 99.96% | 0.01% | 99.97% | 0.01% | 0.05% | 0.00% | 0.02% | 99.99% | 0.01% | 0.01% |
| nogRNA-G1397spilt-KKH-Cas9-G1397-N and dSpCas9-G1397-C | C | 0.01% | 0.02% | 0.01% | 0.01% | 0.02% | 0.03% | 0.00% | 99.99% | 99.98% | 0.00% | 99.99% | 0.03% |

TABLE 10C-continued

| No gRNA | | | | | | | | | | | | | |
|---|---|---|---|---|---|---|---|---|---|---|---|---|---|
| nogRNA-G1397spilt-KKH-Cas9-G1397-N and dSpCas9-G1397-C | G | 0.00% | 0.04% | 0.00% | 99.91% | 0.00% | 0.02% | 99.95% | 0.00% | 0.00% | 0.00% | 0.00% | 0.03% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.02% | 0.07% | 0.02% | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | A | 0.00% | 99.87% | 0.00% | 0.05% | 0.02% | 99.95% | 0.01% | 0.00% | 0.01% | 0.01% | 0.00% | 99.96% |
| nogRNA-G1397spilt-KKH-Cas9-G1397-C and dSpCas9-G1397-N | T | 99.92% | 0.01% | 99.96% | 0.02% | 99.95% | 0.01% | 0.05% | 0.01% | 0.01% | 99.97% | 0.01% | 0.00% |
| nogRNA-G1397spilt-KKH-Cas9-G1397-C and dSpCas9-G1397-N | C | 0.02% | 0.01% | 0.02% | 0.01% | 0.02% | 0.01% | 0.00% | 99.98% | 99.98% | 0.01% | 99.99% | 0.01% |
| nogRNA-G1397spilt-KKH-Cas9-G1397-C and dSpCas9-G1397-N | G | 0.01% | 0.05% | 0.01% | 99.92% | 0.00% | 0.02% | 99.94% | 0.00% | 0.00% | 0.01% | 0.00% | 0.02% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.06% | 0.06% | 0.01% | 0.00% | 0.01% | 0.00% | 0.00% | 0.00% | 0.00% | 0.00% | 0.00% | 0.00% |
| nogRNA-N1357spilt-KKH-Cas9-N1357-N and dSpCas9-N1357-C | A | 0.00% | 99.89% | 0.01% | 0.07% | 0.03% | 99.95% | 0.02% | 0.00% | 0.02% | 0.00% | 0.00% | 99.95% |
| nogRNA-N1357spilt-KKH-Cas9-N1357-N and dSpCas9-N1357-C | T | 99.97% | 0.01% | 99.97% | 0.02% | 99.97% | 0.01% | 0.06% | 0.02% | 0.01% | 99.97% | 0.02% | 0.02% |
| nogRNA-N1357spilt-KKH-Cas9-N1357-N and dSpCas9-N1357-C | C | 0.02% | 0.01% | 0.01% | 0.00% | 0.00% | 0.02% | 0.00% | 99.98% | 99.97% | 0.03% | 99.98% | 0.02% |
| nogRNA-N1357spilt-KKH-Cas9-N1357-N and dSpCas9-N1357-C | G | 0.00% | 0.05% | 0.00% | 99.92% | 0.00% | 0.02% | 99.92% | 0.00% | 0.00% | 0.00% | 0.00% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.01% | 0.04% | 0.01% | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.01% | 99.85% | 0.01% | 0.05% | 0.01% | 99.92% | 0.01% | 0.00% | 0.01% | 0.00% | 0.01% | 99.93% |
| nogRNA-N1357spilt-KKH-Cas9-N1357-C and dSpCas9-N1357-N | T | 99.94% | 0.00% | 99.95% | 0.03% | 99.98% | 0.02% | 0.04% | 0.01% | 0.00% | 99.98% | 0.01% | 0.01% |
| nogRNA-N1357spilt-KKH-Cas9-N1357-C and dSpCas9-N1357-N | C | 0.01% | 0.04% | 0.02% | 0.00% | 0.01% | 0.04% | 0.01% | 99.99% | 99.99% | 0.02% | 99.97% | 0.04% |
| nogRNA-N1357spilt-KKH-Cas9-N1357-C and dSpCas9-N1357-N | G | 0.00% | 0.04% | 0.01% | 99.92% | 0.00% | 0.02% | 99.94% | 0.00% | 0.00% | 0.00% | 0.01% | 0.02% |

TABLE 10C-continued

| No gRNA | | | | | | | | | | | | | |
|---|---|---|---|---|---|---|---|---|---|---|---|---|---|
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.04% | 0.07% | 0.01% | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.01% | 99.85% | 0.00% | 0.04% | 0.02% | 99.90% | 0.01% | 0.00% | 0.01% | 0.00% | 0.00% | 99.95% |
| nogRNA-N1387spilt-KKH-Cas9-N1387-N and dSpCas9-N1387-C | T | 99.94% | 0.01% | 99.96% | 0.02% | 99.96% | 0.01% | 0.07% | 0.01% | 0.00% | 99.96% | 0.03% | 0.00% |
| nogRNA-N1387spilt-KKH-Cas9-N1387-N and dSpCas9-N1387-C | C | 0.01% | 0.01% | 0.02% | 0.00% | 0.01% | 0.03% | 0.00% | 99.99% | 99.99% | 0.02% | 99.97% | 0.03% |
| nogRNA-N1387spilt-KKH-Cas9-N1387-N and dSpCas9-N1387-C | G | 0.01% | 0.06% | 0.00% | 99.94% | 0.00% | 0.06% | 99.92% | 0.00% | 0.00% | 0.01% | 0.00% | 0.02% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.02% | 0.07% | 0.02% | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.00% | 99.86% | 0.01% | 0.04% | 0.03% | 99.92% | 0.01% | 0.00% | 0.00% | 0.00% | 0.00% | 99.94% |
| nogRNA-N1387spilt-KKH-Cas9-N1387-C and dSpCas9-N1387-N | T | 99.94% | 0.00% | 99.98% | 0.02% | 99.96% | 0.00% | 0.09% | 0.01% | 0.01% | 99.97% | 0.03% | 0.00% |
| nogRNA-N1387spilt-KKH-Cas9-N1387-C and dSpCas9-N1387-N | C | 0.01% | 0.02% | 0.01% | 0.00% | 0.01% | 0.03% | 0.00% | 99.99% | 99.99% | 0.01% | 99.96% | 0.04% |
| nogRNA-N1387spilt-KKH-Cas9-N1387-C and dSpCas9-N1387-N | G | 0.01% | 0.06% | 0.00% | 99.94% | 0.00% | 0.04% | 99.89% | 0.00% | 0.00% | 0.01% | 0.00% | 0.02% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.04% | 0.05% | 0.00% | 0.01% | 0.00% | 0.00% | 0.00% | 0.00% | 0.00% | 0.00% | 0.00% | 0.00% |

| Batch | Nucleotide | G | T | C | T | T | C | C | C | A |
|---|---|---|---|---|---|---|---|---|---|---|
| nogRNA-A1343spilt-KKH-Cas9-A1343-N and dSpCas9-A1343-C | A | 0.01% | 0.00% | 0.00% | 0.00% | 0.00% | 0.01% | 0.02% | 0.01% | 99.97% |
| nogRNA-A1343spilt-KKH-Cas9-A1343-N and dSpCas9-A1343-C | T | 0.00% | 99.99% | 0.01% | 99.98% | 99.95% | 0.01% | 0.00% | 0.02% | 0.01% |
| nogRNA-A1343spilt-KKH-Cas9-A1343-N and dSpCas9-A1343-C | C | 0.00% | 0.00% | 99.99% | 0.00% | 0.02% | 99.98% | 99.98% | 99.98% | 0.00% |
| nogRNA-A1343spilt-KKH-Cas9-A1343-N and dSpCas9-A1343-C | G | 99.98% | 0.00% | 0.00% | 0.01% | 0.03% | 0.00% | 0.01% | 0.00% | 0.02% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-A1343spilt-KKH-Cas9-A1343-C and dSpCas9-A1343-N | A | 0.00% | 0.01% | 0.00% | 0.00% | 0.00% | 0.00% | 0.01% | 0.00% | 99.95% |
| nogRNA-A1343spilt-KKH-Cas9-A1343-C and dSpCas9-A1343-N | T | 0.00% | 99.98% | 0.01% | 99.99% | 99.95% | 0.01% | 0.02% | 0.02% | 0.01% |
| nogRNA-A1343spilt-KKH-Cas9-A1343-C and dSpCas9-A1343-N | C | 0.00% | 0.01% | 99.99% | 0.00% | 0.02% | 99.99% | 99.97% | 99.98% | 0.02% |
| nogRNA-A1343spilt-KKH-Cas9-A1343-C and dSpCas9-A1343-N | G | 99.99% | 0.00% | 0.00% | 0.01% | 0.02% | 0.00% | 0.00% | 0.00% | 0.02% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 0.01% | 0.00% | 0.00% | 0.00% | 0.00% | 0.01% | 0.01% | 99.95% |
| nogRNA-G1322spilt-KKH-Cas9-G1322-N and dSpCas9-G1322-C | T | 0.01% | 99.98% | 0.00% | 99.98% | 99.96% | 0.01% | 0.00% | 0.01% | 0.01% |
| nogRNA-G1322spilt-KKH-Cas9-G1322-N and dSpCas9-G1322-C | C | 0.00% | 0.01% | 100.00% | 0.02% | 0.02% | 99.99% | 99.99% | 99.97% | 0.01% |
| nogRNA-G1322spilt-KKH-Cas9-G1322-N and dSpCas9-G1322-C | G | 99.99% | 0.00% | 0.00% | 0.00% | 0.02% | 0.00% | 0.00% | 0.00% | 0.03% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.01% | 0.00% |
| nogRNA-G1322spilt-KKH-Cas9-G1322-C and dSpCas9-G1322-N | A | 0.02% | 0.01% | 0.00% | 0.00% | 0.01% | 0.00% | 0.00% | 0.00% | 99.94% |
| nogRNA-G1322spilt-KKH-Cas9-G1322-C and dSpCas9-G1322-N | T | 0.01% | 99.98% | 0.00% | 99.97% | 99.95% | 0.01% | 0.01% | 0.01% | 0.01% |
| nogRNA-G1322spilt-KKH-Cas9-G1322-C and dSpCas9-G1322-N | C | 0.00% | 0.01% | 99.99% | 0.02% | 0.02% | 99.99% | 99.99% | 99.98% | 0.01% |
| nogRNA-G1322spilt-KKH-Cas9-G1322-C and dSpCas9-G1322-N | G | 99.97% | 0.00% | 0.00% | 0.00% | 0.02% | 0.00% | 0.00% | 0.00% | 0.04% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 0.01% | 0.00% | 0.00% | 0.00% | 0.00% | 0.00% | 0.00% | 99.97% |
| nogRNA-G1333spilt-KKH-Cas9-G1333-N and dSpCas9-G1333-C | T | 0.00% | 99.97% | 0.00% | 100.00% | 99.96% | 0.01% | 0.00% | 0.02% | 0.00% |
| nogRNA-G1333spilt-KKH-Cas9-G1333-N and dSpCas9-G1333-C | C | 0.00% | 0.02% | 100.00% | 0.00% | 0.02% | 99.99% | 99.99% | 99.98% | 0.00% |
| nogRNA-G1333spilt-KKH-Cas9-G1333-N and dSpCas9-G1333-C | G | 99.99% | 0.00% | 0.00% | 0.00% | 0.02% | 0.00% | 0.00% | 0.00% | 0.03% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.01% | 0.00% | 0.00% | 0.00% | 0.00% | 0.00% | 0.00% | 0.00% | 99.95% |
| nogRNA-G1333spilt-KKH-Cas9-G1333-C and dSpCas9-G1333-N | T | 0.00% | 99.96% | 0.02% | 99.97% | 99.97% | 0.01% | 0.00% | 0.02% | 0.00% |

TABLE 10C-continued

| No gRNA | | | | | | | | | | |
|---|---|---|---|---|---|---|---|---|---|---|
| nogRNA-G1333spilt-KKH-Cas9-G1333-C and dSpCas9-G1333-N | C | 0.00% | 0.03% | 99.98% | 0.02% | 0.01% | 99.99% | 99.98% | 99.98% | 0.00% |
| nogRNA-G1333spilt-KKH-Cas9-G1333-C and dSpCas9-G1333-N | G | 99.98% | 0.00% | 0.00% | 0.01% | 0.01% | 0.00% | 0.01% | 0.00% | 0.04% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.02% | 0.01% | 0.00% | 0.00% | 0.00% | 0.00% | 0.01% | 0.00% | 99.96% |
| nogRNA-G1371spilt-KKH-Cas9-G1371-N and dSpCas9-G1371-C | T | 0.01% | 99.98% | 0.00% | 99.97% | 99.95% | 0.01% | 0.01% | 0.01% | 0.00% |
| nogRNA-G1371spilt-KKH-Cas9-G1371-N and dSpCas9-G1371-C | C | 0.00% | 0.01% | 100.00% | 0.02% | 0.03% | 99.99% | 99.98% | 99.98% | 0.01% |
| nogRNA-G1371spilt-KKH-Cas9-G1371-N and dSpCas9-G1371-C | G | 99.97% | 0.00% | 0.00% | 0.01% | 0.02% | 0.00% | 0.00% | 0.00% | 0.03% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.01% | 0.00% |
| nogRNA-G1371spilt-KKH-Cas9-G1371-C and dSpCas9-G1371-N | A | 0.00% | 0.00% | 0.01% | 0.00% | 0.00% | 0.01% | 0.01% | 0.00% | 99.95% |
| nogRNA-G1371spilt-KKH-Cas9-G1371-C and dSpCas9-G1371-N | T | 0.01% | 99.98% | 0.01% | 99.96% | 99.97% | 0.01% | 0.00% | 0.00% | 0.01% |
| nogRNA-G1371spilt-KKH-Cas9-G1371-C and dSpCas9-G1371-N | C | 0.00% | 0.02% | 99.98% | 0.02% | 0.01% | 99.99% | 99.99% | 99.99% | 0.01% |
| nogRNA-G1371spilt-KKH-Cas9-G1371-C and dSpCas9-G1371-N | G | 99.99% | 0.00% | 0.00% | 0.02% | 0.01% | 0.00% | 0.00% | 0.00% | 0.03% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.00% | 0.01% | 0.00% | 0.00% | 0.00% | 0.00% | 0.01% | 0.02% | 99.97% |
| nogRNA-G1397spilt-KKH-Cas9-G1397-N and dSpCas9-G1397-C | T | 0.02% | 99.97% | 0.00% | 99.96% | 99.98% | 0.02% | 0.00% | 0.01% | 0.01% |
| nogRNA-G1397spilt-KKH-Cas9-G1397-N and dSpCas9-G1397-C | C | 0.00% | 0.02% | 99.99% | 0.03% | 0.02% | 99.98% | 99.98% | 99.95% | 0.00% |
| nogRNA-G1397spilt-KKH-Cas9-G1397-N and dSpCas9-G1397-C | G | 99.98% | 0.00% | 0.01% | 0.00% | 0.00% | 0.00% | 0.00% | 0.00% | 0.01% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% | 0.02% | 0.00% |
| nogRNA-G1397spilt-KKH-Cas9-G1397-C and dSpCas9-G1397-N | A | 0.01% | 0.00% | 0.00% | 0.00% | 0.00% | 0.00% | 0.00% | 0.01% | 99.96% |
| nogRNA-G1397spilt-KKH-Cas9-G1397-C and dSpCas9-G1397-N | T | 0.00% | 99.98% | 0.01% | 99.98% | 99.95% | 0.02% | 0.01% | 0.00% | 0.01% |
| nogRNA-G1397spilt-KKH-Cas9-G1397-C and dSpCas9-G1397-N | C | 0.00% | 0.02% | 99.99% | 0.01% | 0.03% | 99.97% | 99.98% | 99.98% | 0.00% |
| nogRNA-G1397spilt-KKH-Cas9-G1397-C and dSpCas9-G1397-N | G | 99.99% | 0.00% | 0.00% | 0.01% | 0.02% | 0.00% | 0.01% | 0.00% | 0.02% |

TABLE 10C-continued

| | | No gRNA | | | | | | | | |
|---|---|---|---|---|---|---|---|---|---|---|
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | A | 0.01% | 0.01% | 0.00% | 0.01% | 0.01% | 0.00% | 0.01% | 0.01% | 99.98% |
| nogRNA-N1357spilt-KKH-Cas9-N1357-N and dSpCas9-N1357-C | T | 0.00% | 99.97% | 0.00% | 99.98% | 99.97% | 0.01% | 0.01% | 0.01% | 0.00% |
| nogRNA-N1357spilt-KKH-Cas9-N1357-N and dSpCas9-N1357-C | C | 0.00% | 0.02% | 100.00% | 0.01% | 0.02% | 99.99% | 99.98% | 99.98% | 0.00% |
| nogRNA-N1357spilt-KKH-Cas9-N1357-N and dSpCas9-N1357-C | G | 99.98% | 0.00% | 0.00% | 0.01% | 0.01% | 0.00% | 0.00% | 0.00% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.02% | 0.01% | 0.00% | 0.01% | 0.01% | 0.01% | 0.01% | 0.01% | 99.93% |
| nogRNA-N1357spilt-KKH-Cas9-N1357-C and dSpCas9-N1357-N | T | 0.00% | 99.98% | 0.01% | 99.97% | 99.97% | 0.01% | 0.00% | 0.02% | 0.00% |
| nogRNA-N1357spilt-KKH-Cas9-N1357-C and dSpCas9-N1357-N | C | 0.00% | 0.01% | 99.99% | 0.02% | 0.01% | 99.98% | 99.99% | 99.98% | 0.02% |
| nogRNA-N1357spilt-KKH-Cas9-N1357-C and dSpCas9-N1357-N | G | 99.98% | 0.00% | 0.00% | 0.01% | 0.01% | 0.00% | 0.00% | 0.00% | 0.04% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.00% | 0.00% | 0.00% | 0.00% | 0.01% | 0.00% | 0.01% | 0.02% | 99.96% |
| nogRNA-N1387spilt-KKH-Cas9-N1387-N and dSpCas9-N1387-C | T | 0.00% | 99.98% | 0.01% | 99.98% | 99.96% | 0.00% | 0.00% | 0.01% | 0.01% |
| nogRNA-N1387spilt-KKH-Cas9-N1387-N and dSpCas9-N1387-C | C | 0.00% | 0.01% | 99.98% | 0.01% | 0.01% | 100.00% | 99.98% | 99.97% | 0.01% |
| nogRNA-N1387spilt-KKH-Cas9-N1387-N and dSpCas9-N1387-C | G | 100.00% | 0.00% | 0.00% | 0.01% | 0.02% | 0.00% | 0.00% | 0.00% | 0.03% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.01% | 0.00% | 0.00% | 0.00% | 0.01% | 0.00% | 0.00% | 0.00% | 99.96% |
| nogRNA-N1387spilt-KKH-Cas9-N1387-C and dSpCas9-N1387-N | T | 0.00% | 100.00% | 0.00% | 99.97% | 99.95% | 0.01% | 0.01% | 0.00% | 0.01% |
| nogRNA-N1387spilt-KKH-Cas9-N1387-C and dSpCas9-N1387-N | C | 0.00% | 0.00% | 100.00% | 0.01% | 0.02% | 99.98% | 99.99% | 99.99% | 0.00% |
| nogRNA-N1387spilt-KKH-Cas9-N1387-C and dSpCas9-N1387-N | G | 99.99% | 0.00% | 0.00% | 0.01% | 0.02% | 0.00% | 0.00% | 0.00% | 0.03% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% | 0.00% |

| Batch | Nucleotide | T | C | A | G | G | C | T | C |
|---|---|---|---|---|---|---|---|---|---|
| nogRNA-A1343spilt-KKH-Cas9-A1343-N and dSpCas9-A1343-C | A | 0.00% | 0.00% | 99.98% | 0.00% | 0.03% | 0.00% | 0.00% | 0.01% |
| nogRNA-A1343spilt-KKH-Cas9-A1343-N and dSpCas9-A1343-C | T | 99.99% | 0.01% | 0.00% | 0.00% | 0.01% | 0.01% | 100.00% | 0.01% |
| nogRNA-A1343spilt-KKH-Cas9-A1343-N and dSpCas9-A1343-C | C | 0.00% | 99.99% | 0.00% | 0.00% | 0.00% | 99.99% | 0.00% | 99.98% |
| nogRNA-A1343spilt-KKH-Cas9-A1343-N and dSpCas9-A1343-C | G | 0.00% | 0.00% | 0.02% | 99.99% | 99.96% | 0.00% | 0.00% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.01% | 0.01% | 99.95% | 0.01% | 0.00% | 0.00% | 0.00% | 0.00% |
| nogRNA-A1343spilt-KKH-Cas9-A1343-C and dSpCas9-A1343-N | T | 99.99% | 0.01% | 0.02% | 0.00% | 0.00% | 0.00% | 99.98% | 0.00% |
| nogRNA-A1343spilt-KKH-Cas9-A1343-C and dSpCas9-A1343-N | C | 0.00% | 99.97% | 0.03% | 0.00% | 0.00% | 100.00% | 0.02% | 99.99% |
| nogRNA-A1343spilt-KKH-Cas9-A1343-C and dSpCas9-A1343-N | G | 0.00% | 0.00% | 0.00% | 99.99% | 10.000% | 0.00% | 0.00% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.01% | 0.01% | 99.94% | 0.00% | 0.01% | 0.00% | 0.00% | 0.01% |
| nogRNA-G1322spilt-KKH-Cas9-G1322-N and dSpCas9-G1322-C | T | 99.98% | 0.01% | 0.03% | 0.01% | 0.00% | 0.00% | 99.99% | 0.01% |
| nogRNA-G1322spilt-KKH-Cas9-G1322-N and dSpCas9-G1322-C | C | 0.00% | 99.98% | 0.00% | 0.00% | 0.00% | 100.00% | 0.00% | 99.99% |
| nogRNA-G1322spilt-KKH-Cas9-G1322-N and dSpCas9-G1322-C | G | 0.01% | 0.00% | 0.03% | 99.99% | 99.99% | 0.00% | 0.00% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 0.00% | 99.96% | 0.00% | 0.01% | 0.00% | 0.00% | 0.00% |
| nogRNA-G1322spilt-KKH-Cas9-G1322-C and dSpCas9-G1322-N | T | 99.97% | 0.01% | 0.01% | 0.02% | 0.01% | 0.01% | 99.99% | 0.01% |
| nogRNA-G1322spilt-KKH-Cas9-G1322-C and dSpCas9-G1322-N | C | 0.01% | 99.99% | 0.02% | 0.00% | 0.00% | 99.99% | 0.00% | 99.99% |
| nogRNA-G1322spilt-KKH-Cas9-G1322-C and dSpCas9-G1322-N | G | 0.02% | 0.00% | 0.01% | 99.98% | 99.98% | 0.00% | 0.00% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% |

TABLE 10C-continued

| No gRNA | | | | | | | | | |
|---|---|---|---|---|---|---|---|---|---|
| nogRNA-G1333spilt-KKH-Cas9-G1333-N and dSpCas9-G1333-C | A | 0.00% | 0.00% | 99.95% | 0.01% | 0.01% | 0.00% | 0.00% | 0.00% |
| nogRNA-G1333spilt-KKH-Cas9-G1333-N and dSpCas9-G1333-C | T | 99.97% | 0.00% | 0.01% | 0.00% | 0.00% | 0.01% | 100.00% | 0.00% |
| nogRNA-G1333spilt-KKH-Cas9-G1333-N and dSpCas9-G1333-C | C | 0.02% | 100.00% | 0.00% | 0.00% | 0.00% | 99.98% | 0.00% | 99.99% |
| nogRNA-G1333spilt-KKH-Cas9-G1333-N and dSpCas9-G1333-C | G | 0.00% | 0.00% | 0.03% | 99.99% | 99.99% | 0.00% | 0.00% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.01% | 99.95% | 0.02% | 0.01% | 0.00% | 0.01% | 0.00% |
| nogRNA-G1333spilt-KKH-Cas9-G1333-C and dSpCas9-G1333-N | T | 99.98% | 0.00% | 0.02% | 0.00% | 0.01% | 0.00% | 99.98% | 0.00% |
| nogRNA-G1333spilt-KKH-Cas9-G1333-C and dSpCas9-G1333-N | C | 0.01% | 99.98% | 0.00% | 0.00% | 0.00% | 100.00% | 0.01% | 100.00% |
| nogRNA-G1333spilt-KKH-Cas9-G1333-C and dSpCas9-G1333-N | G | 0.01% | 0.00% | 0.02% | 99.98% | 99.97% | 0.00% | 0.00% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.00% | 0.01% | 99.97% | 0.01% | 0.00% | 0.00% | 0.00% | 0.00% |
| nogRNA-G1371spilt-KKH-Cas9-G1371-N and dSpCas9-G1371-C | T | 99.98% | 0.02% | 0.01% | 0.01% | 0.02% | 0.00% | 99.98% | 0.00% |
| nogRNA-G1371spilt-KKH-Cas9-G1371-N and dSpCas9-G1371-C | C | 0.01% | 99.97% | 0.00% | 0.00% | 0.00% | 99.99% | 0.01% | 100.00% |
| nogRNA-G1371spilt-KKH-Cas9-G1371-N and dSpCas9-G1371-C | G | 0.01% | 0.00% | 0.02% | 99.98% | 99.98% | 0.00% | 0.00% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.01% | 0.00% | 99.94% | 0.00% | 0.01% | 0.00% | 0.00% | 0.01% |
| nogRNA-G1371spilt-KKH-Cas9-G1371-C and dSpCas9-G1371-N | T | 99.98% | 0.01% | 0.02% | 0.01% | 0.01% | 0.00% | 99.99% | 0.01% |
| nogRNA-G1371spilt-KKH-Cas9-G1371-C and dSpCas9-G1371-N | C | 0.00% | 99.98% | 0.01% | 0.00% | 0.00% | 99.99% | 0.01% | 99.99% |
| nogRNA-G1371spilt-KKH-Cas9-G1371-C and dSpCas9-G1371-N | G | 0.01% | 0.00% | 0.03% | 99.99% | 99.98% | 0.00% | 0.00% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.01% | 0.00% | 99.94% | 0.00% | 0.01% | 0.00% | 0.01% | 0.01% |
| nogRNA-G1397spilt-KKH-Cas9-G1397-N and dSpCas9-G1397-C | T | 99.99% | 0.03% | 0.02% | 0.00% | 0.00% | 0.00% | 99.99% | 0.01% |

TABLE 10C-continued

| No gRNA | | | | | | | | | |
|---|---|---|---|---|---|---|---|---|---|
| nogRNA-G1397spilt-KKH-Cas9-G1397-N and dSpCas9-G1397-C | C | 0.00% | 99.96% | 0.00% | 0.00% | 0.00% | 100.00% | 0.00% | 99.98% |
| nogRNA-G1397spilt-KKH-Cas9-G1397-N and dSpCas9-G1397-C | G | 0.00% | 0.00% | 0.03% | 100.00% | 99.99% | 0.00% | 0.00% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | A | 0.00% | 0.01% | 99.95% | 0.01% | 0.00% | 0.00% | 0.00% | 0.00% |
| nogRNA-G1397spilt-KKH-Cas9-G1397-C and dSpCas9-G1397-N | T | 99.97% | 0.02% | 0.02% | 0.00% | 0.00% | 0.00% | 99.97% | 0.01% |
| nogRNA-G1397spilt-KKH-Cas9-G1397-C and dSpCas9-G1397-N | C | 0.01% | 99.97% | 0.00% | 0.00% | 0.00% | 100.00% | 0.01% | 99.99% |
| nogRNA-G1397spilt-KKH-Cas9-G1397-C and dSpCas9-G1397-N | G | 0.02% | 0.00% | 0.02% | 99.99% | 99.99% | 0.00% | 0.01% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | A | 0.00% | 0.01% | 99.96% | 0.01% | 0.01% | 0.00% | 0.00% | 0.00% |
| nogRNA-N1357spilt-KKH-Cas9-N1357-N and dSpCas9-N1357-C | T | 99.98% | 0.01% | 0.01% | 0.00% | 0.01% | 0.01% | 99.99% | 0.01% |
| nogRNA-N1357spilt-KKH-Cas9-N1357-N and dSpCas9-N1357-C | C | 0.00% | 99.98% | 0.01% | 0.00% | 0.00% | 99.99% | 0.00% | 99.99% |
| nogRNA-N1357spilt-KKH-Cas9-N1357-N and dSpCas9-N1357-C | G | 0.01% | 0.00% | 0.02% | 99.99% | 99.98% | 0.00% | 0.00% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.01% | 0.01% | 99.93% | 0.00% | 0.01% | 0.00% | 0.00% | 0.00% |
| nogRNA-N1357spilt-KKH-Cas9-N1357-C and dSpCas9-N1357-N | T | 99.98% | 0.02% | 0.01% | 0.01% | 0.00% | 0.00% | 99.98% | 0.01% |
| nogRNA-N1357spilt-KKH-Cas9-N1357-C and dSpCas9-N1357-N | C | 0.01% | 99.97% | 0.03% | 0.00% | 0.00% | 99.99% | 0.01% | 99.99% |
| nogRNA-N1357spilt-KKH-Cas9-N1357-C and dSpCas9-N1357-N | G | 0.01% | 0.00% | 0.03% | 99.99% | 99.99% | 0.01% | 0.01% | 0.00% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.00% | 0.00% | 99.95% | 0.00% | 0.00% | 0.00% | 0.00% | 0.00% |
| nogRNA-N1387spilt-KKH-Cas9-N1387-N and dSpCas9-N1387-C | T | 99.98% | 0.01% | 0.02% | 0.00% | 0.00% | 0.00% | 99.98% | 0.01% |
| nogRNA-N1387spilt-KKH-Cas9-N1387-N and dSpCas9-N1387-C | C | 0.01% | 99.98% | 0.01% | 0.00% | 0.00% | 99.98% | 0.02% | 99.99% |
| nogRNA-N1387spilt-KKH-Cas9-N1387-N and dSpCas9-N1387-C | G | 0.01% | 0.00% | 0.02% | 100.00% | 99.99% | 0.01% | 0.00% | 0.00% |

TABLE 10C-continued

| | | | | | | | | | |
|---|---|---|---|---|---|---|---|---|---|
| No gRNA | | | | | | | | | |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.00% | 0.00% | 99.96% | 0.01% | 0.01% | 0.00% | 0.00% | 0.00% |
| nogRNA-N1387spilt-KKH-Cas9-N1387-C and dSpCas9-N1387-N | T | 99.97% | 0.02% | 0.01% | 0.00% | 0.00% | 0.00% | 99.98% | 0.00% |
| nogRNA-N1387spilt-KKH-Cas9-N1387-C and dSpCas9-N1387-N | C | 0.02% | 99.97% | 0.01% | 0.00% | 0.00% | 100.00% | 0.01% | 100.00% |
| nogRNA-N1387spilt-KKH-Cas9-N1387-C and dSpCas9-N1387-N | G | 0.01% | 0.00% | 0.02% | 99.98% | 99.99% | 0.00% | 0.00% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% |

| Batch | Nucleotide | T | C | A | G | C | T | C |
|---|---|---|---|---|---|---|---|---|
| nogRNA-A1343spilt-KKH-Cas9-A1343-N and dSpCas9-A1343-C | A | 0.01% | 0.00% | 99.97% | 0.02% | 0.01% | 0.00% | 0.00% |
| nogRNA-A1343spilt-KKH-Cas9-A1343-N and dSpCas9-A1343-C | T | 99.97% | 0.03% | 0.00% | 0.00% | 0.01% | 99.99% | 0.02% |
| nogRNA-A1343spilt-KKH-Cas9-A1343-N and dSpCas9-A1343-C | C | 0.02% | 99.96% | 0.00% | 0.00% | 99.98% | 0.01% | 99.98% |
| nogRNA-A1343spilt-KKH-Cas9-A1343-N and dSpCas9-A1343-C | G | 0.00% | 0.00% | 0.02% | 99.98% | 0.00% | 0.00% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 0.01% | 99.96% | 0.01% | 0.00% | 0.00% | 0.00% |
| nogRNA-A1343spilt-KKH-Cas9-A1343-C and dSpCas9-A1343-N | T | 99.97% | 0.02% | 0.00% | 0.00% | 0.01% | 99.98% | 0.00% |
| nogRNA-A1343spilt-KKH-Cas9-A1343-C and dSpCas9-A1343-N | C | 0.02% | 99.97% | 0.01% | 0.00% | 99.99% | 0.01% | 99.99% |
| nogRNA-A1343spilt-KKH-Cas9-A1343-C and dSpCas9-A1343-N | G | 0.00% | 0.00% | 0.03% | 99.98% | 0.00% | 0.00% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 0.01% | 99.98% | 0.01% | 0.00% | 0.00% | 0.01% |
| nogRNA-G1322spilt-KKH-Cas9-G1322-N and dSpCas9-G1322-C | T | 99.98% | 0.01% | 0.01% | 0.00% | 0.00% | 99.98% | 0.02% |
| nogRNA-G1322spilt-KKH-Cas9-G1322-N and dSpCas9-G1322-C | C | 0.02% | 99.98% | 0.00% | 0.00% | 100.00% | 0.01% | 99.97% |
| nogRNA-G1322spilt-KKH-Cas9-G1322-N and dSpCas9-G1322-C | G | 0.00% | 0.00% | 0.01% | 99.98% | 0.00% | 0.01% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% |

TABLE 10C-continued

| No gRNA | | | | | | | | |
|---|---|---|---|---|---|---|---|---|
| nogRNA-G1322spilt-KKH-Cas9-G1322-N and dSpCas9-G1322-C | — | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 0.00% | 99.98% | 0.00% | 0.00% | 0.00% | 0.00% |
| nogRNA-G1322spilt-KKH-Cas9-G1322-C and dSpCas9-G1322-N | T | 99.97% | 0.01% | 0.00% | 0.01% | 0.00% | 99.98% | 0.03% |
| nogRNA-G1322spilt-KKH-Cas9-G1322-C and dSpCas9-G1322-N | C | 0.03% | 99.99% | 0.00% | 0.01% | 100.00% | 0.01% | 99.97% |
| nogRNA-G1322spilt-KKH-Cas9-G1322-C and dSpCas9-G1322-N | G | 0.00% | 0.00% | 0.02% | 99.98% | 0.00% | 0.01% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 0.02% | 100.00% | 0.02% | 0.00% | 0.00% | 0.00% |
| nogRNA-G1333spilt-KKH-Cas9-G1333-N and dSpCas9-G1333-C | T | 99.99% | 0.01% | 0.00% | 0.00% | 0.00% | 100.00% | 0.02% |
| nogRNA-G1333spilt-KKH-Cas9-G1333-N and dSpCas9-G1333-C | C | 0.00% | 99.97% | 0.00% | 0.00% | 100.00% | 0.00% | 99.98% |
| nogRNA-G1333spilt-KKH-Cas9-G1333-N and dSpCas9-G1333-C | G | 0.00% | 0.00% | 0.00% | 99.98% | 0.00% | 0.00% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.00% | 99.97% | 0.01% | 0.00% | 0.00% | 0.01% |
| nogRNA-G1333spilt-KKH-Cas9-G1333-C and dSpCas9-G1333-N | T | 99.98% | 0.01% | 0.01% | 0.00% | 0.00% | 100.00% | 0.01% |
| nogRNA-G1333spilt-KKH-Cas9-G1333-C and dSpCas9-G1333-N | C | 0.01% | 99.98% | 0.00% | 0.00% | 10.000% | 0.00% | 99.98% |
| nogRNA-G1333spilt-KKH-Cas9-G1333-C and dSpCas9-G1333-N | G | 0.00% | 0.00% | 0.02% | 99.99% | 0.00% | 0.00% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.02% | 0.02% | 99.98% | 0.01% | 0.00% | 0.00% | 0.00% |
| nogRNA-G1371spilt-KKH-Cas9-G1371-N and dSpCas9-G1371-C | T | 99.98% | 0.01% | 0.00% | 0.01% | 0.01% | 99.99% | 0.02% |
| nogRNA-G1371spilt-KKH-Cas9-G1371-N and dSpCas9-G1371-C | C | 0.00% | 99.98% | 0.00% | 0.01% | 99.99% | 0.00% | 99.97% |
| nogRNA-G1371spilt-KKH-Cas9-G1371-N and dSpCas9-G1371-C | G | 0.00% | 0.00% | 0.02% | 99.98% | 0.00% | 0.00% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.01% | 0.00% | 99.93% | 0.01% | 0.00% | 0.00% | 0.01% |

TABLE 10C-continued

| | | No gRNA | | | | | | |
|---|---|---|---|---|---|---|---|---|
| nogRNA-G1371spilt-KKH-Cas9-G1371-C and dSpCas9-G1371-N | T | 99.99% | 0.01% | 0.01% | 0.00% | 0.01% | 99.98% | 0.03% |
| nogRNA-G1371spilt-KKH-Cas9-G1371-C and dSpCas9-G1371-N | C | 0.00% | 99.99% | 0.01% | 0.00% | 99.99% | 0.01% | 99.96% |
| nogRNA-G1371spilt-KKH-Cas9-G1371-C and dSpCas9-G1371-N | G | 0.01% | 0.00% | 0.06% | 99.99% | 0.00% | 0.01% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.00% | 0.01% | 99.98% | 0.02% | 0.00% | 0.00% | 0.00% |
| nogRNA-G1397spilt-KKH-Cas9-G1397-N and dSpCas9-G1397-C | T | 99.99% | 0.03% | 0.00% | 0.00% | 0.01% | 99.99% | 0.01% |
| nogRNA-G1397spilt-KKH-Cas9-G1397-N and dSpCas9-G1397-C | C | 0.01% | 99.96% | 0.00% | 0.00% | 99.99% | 0.00% | 99.99% |
| nogRNA-G1397spilt-KKH-Cas9-G1397-N and dSpCas9-G1397-C | G | 0.00% | 0.00% | 0.02% | 99.98% | 0.00% | 0.00% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% |
| nogRNA-G1397spilt-KKH-Cas9-G1397-C and dSpCas9-G1397-N | A | 0.01% | 0.00% | 99.96% | 0.01% | 0.00% | 0.01% | 0.01% |
| nogRNA-G1397spilt-KKH-Cas9-G1397-C and dSpCas9-G1397-N | T | 99.98% | 0.01% | 0.00% | 0.02% | 0.00% | 99.96% | 0.03% |
| nogRNA-G1397spilt-KKH-Cas9-G1397-C and dSpCas9-G1397-N | C | 0.01% | 99.98% | 0.00% | 0.00% | 100.00% | 0.01% | 99.96% |
| nogRNA-G1397spilt-KKH-Cas9-G1397-C and dSpCas9-G1397-N | G | 0.00% | 0.01% | 0.04% | 99.97% | 0.00% | 0.01% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.00% | 0.00% |
| nogRNA-N1357spilt-KKH-Cas9-N1357-N and dSpCas9-N1357-C | A | 0.00% | 0.01% | 99.98% | 0.03% | 0.00% | 0.00% | 0.01% |
| nogRNA-N1357spilt-KKH-Cas9-N1357-N and dSpCas9-N1357-C | T | 99.98% | 0.02% | 0.00% | 0.00% | 0.00% | 99.99% | 0.01% |
| nogRNA-N1357spilt-KKH-Cas9-N1357-N and dSpCas9-N1357-C | C | 0.00% | 99.97% | 0.00% | 0.00% | 99.99% | 0.00% | 99.98% |
| nogRNA-N1357spilt-KKH-Cas9-N1357-N and dSpCas9-N1357-C | G | 0.00% | 0.00% | 0.02% | 99.97% | 0.00% | 0.01% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.01% | 0.01% | 0.00% | 0.00% | 0.00% | 0.00% | 0.00% |
| nogRNA-N1357spilt-KKH-Cas9-N1357-C and dSpCas9-N1357-N | A | 0.01% | 0.00% | 99.93% | 0.01% | 0.01% | 0.00% | 0.01% |
| nogRNA-N1357spilt-KKH-Cas9-N1357-C and dSpCas9-N1357-N | T | 99.98% | 0.02% | 0.00% | 0.00% | 0.02% | 99.98% | 0.02% |
| nogRNA-N1357spilt-KKH-Cas9-N1357-C and dSpCas9-N1357-N | C | 0.01% | 99.97% | 0.02% | 0.00% | 99.98% | 0.01% | 99.98% |

TABLE 10C-continued

| | | No gRNA | | | | | | |
|---|---|---|---|---|---|---|---|---|
| nogRNA-N1357spilt-KKH-Cas9-N1357-C and dSpCas9-N1357-N | G | 0.00% | 0.01% | 0.04% | 99.99% | 0.00% | 0.01% | 0.00% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.01% | 0.01% | 0.00% | 0.00% | 0.00% | 0.00% | 0.00% |
| nogRNA-N1387spilt-KKH-Cas9-N1387-N and dSpCas9-N1387-C | A | 0.00% | 0.01% | 99.99% | 0.00% | 0.00% | 0.00% | 0.00% |
| nogRNA-N1387spilt-KKH-Cas9-N1387-N and dSpCas9-N1387-C | T | 99.98% | 0.00% | 0.00% | 0.00% | 0.00% | 99.99% | 0.04% |
| nogRNA-N1387spilt-KKH-Cas9-N1387-N and dSpCas9-N1387-C | C | 0.01% | 99.98% | 0.00% | 0.01% | 100.00% | 0.00% | 99.96% |
| nogRNA-N1387spilt-KKH-Cas9-N1387-N and dSpCas9-N1387-C | G | 0.00% | 0.00% | 0.00% | 99.99% | 0.00% | 0.01% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.01% | 0.00% | 99.96% | 0.01% | 0.00% | 0.00% | 0.01% |
| nogRNA-N1387spilt-KKH-Cas9-N1387-C and dSpCas9-N1387-N | T | 99.99% | 0.02% | 0.00% | 0.00% | 0.02% | 99.99% | 0.02% |
| nogRNA-N1387spilt-KKH-Cas9-N1387-C and dSpCas9-N1387-N | C | 0.00% | 99.98% | 0.00% | 0.00% | 99.98% | 0.00% | 99.97% |
| nogRNA-N1387spilt-KKH-Cas9-N1387-C and dSpCas9-N1387-N | G | 0.00% | 0.00% | 0.04% | 99.98% | 0.00% | 0.01% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% |

| Batch | Nucleotide | A | G | C | C | T | G | A | G | T |
|---|---|---|---|---|---|---|---|---|---|---|
| nogRNA-A1343spilt-KKH-Cas9-A1343-N and dSpCas9-A1343-C | A | 99.97% | 0.02% | 0.01% | 0.00% | 0.01% | 0.00% | 99.96% | 0.01% | 0.00% |
| nogRNA-A1343spilt-KKH-Cas9-A1343-N and dSpCas9-A1343-C | T | 0.01% | 0.01% | 0.01% | 0.01% | 99.97% | 0.00% | 0.00% | 0.00% | 99.98% |
| nogRNA-A1343spilt-KKH-Cas9-A1343-N and dSpCas9-A1343-C | C | 0.00% | 0.01% | 99.98% | 99.99% | 0.01% | 0.01% | 0.01% | 0.00% | 0.02% |
| nogRNA-A1343spilt-KKH-Cas9-A1343-N and dSpCas9-A1343-C | G | 0.02% | 99.96% | 0.00% | 0.00% | 0.00% | 99.98% | 0.02% | 99.99% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 99.95% | 0.01% | 0.00% | 0.01% | 0.00% | 0.01% | 99.94% | 0.00% | 0.01% |
| nogRNA-A1343spilt-KKH-Cas9-A1343-C and dSpCas9-A1343-N | T | 0.00% | 0.00% | 0.00% | 0.01% | 99.99% | 0.02% | 0.00% | 0.00% | 99.96% |
| nogRNA-A1343spilt-KKH-Cas9-A1343-C and dSpCas9-A1343-N | C | 0.03% | 0.00% | 100.00% | 99.98% | 0.01% | 0.00% | 0.04% | 0.00% | 0.02% |
| nogRNA-A1343spilt-KKH-Cas9-A1343-C and dSpCas9-A1343-N | G | 0.01% | 99.99% | 0.00% | 0.00% | 0.00% | 99.97% | 0.02% | 100.00% | 0.00% |

TABLE 10C-continued

| No gRNA | | | | | | | | | | |
|---|---|---|---|---|---|---|---|---|---|---|
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 99.98% | 0.01% | 0.00% | 0.00% | 0.01% | 0.01% | 99.95% | 0.00% | 0.02% |
| nogRNA-G1322spilt-KKH-Cas9-G1322-N and dSpCas9-G1322-C | T | 0.00% | 0.01% | 0.00% | 0.01% | 99.97% | 0.01% | 0.00% | 0.00% | 99.95% |
| nogRNA-G1322spilt-KKH-Cas9-G1322-N and dSpCas9-G1322-C | C | 0.00% | 0.00% | 99.99% | 99.98% | 0.02% | 0.00% | 0.02% | 0.00% | 0.01% |
| nogRNA-G1322spilt-KKH-Cas9-G1322-N and dSpCas9-G1322-C | G | 0.02% | 99.98% | 0.00% | 0.00% | 0.00% | 99.98% | 0.03% | 99.99% | 0.02% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 99.98% | 0.00% | 0.00% | 0.00% | 0.01% | 0.03% | 99.97% | 0.01% | 0.01% |
| nogRNA-G1322spilt-KKH-Cas9-G1322-C and dSpCas9-G1322-N | T | 0.00% | 0.00% | 0.00% | 0.01% | 99.97% | 0.00% | 0.01% | 0.00% | 99.98% |
| nogRNA-G1322spilt-KKH-Cas9-G1322-C and dSpCas9-G1322-N | C | 0.01% | 0.00% | 99.99% | 99.99% | 0.02% | 0.00% | 0.01% | 0.00% | 0.00% |
| nogRNA-G1322spilt-KKH-Cas9-G1322-C and dSpCas9-G1322-N | G | 0.01% | 99.99% | 0.00% | 0.00% | 0.00% | 99.97% | 0.01% | 99.99% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 99.99% | 0.01% | 0.01% | 0.00% | 0.00% | 0.03% | 99.99% | 0.00% | 0.00% |
| nogRNA-G1333spilt-KKH-Cas9-G1333-N and dSpCas9-G1333-C | T | 0.00% | 0.00% | 0.01% | 0.02% | 100.00% | 0.01% | 0.00% | 0.00% | 99.97% |
| nogRNA-G1333spilt-KKH-Cas9-G1333-N and dSpCas9-G1333-C | C | 0.00% | 0.01% | 99.98% | 99.98% | 0.00% | 0.00% | 0.00% | 0.00% | 0.02% |
| nogRNA-G1333spilt-KKH-Cas9-G1333-N and dSpCas9-G1333-C | G | 0.01% | 99.98% | 0.00% | 0.00% | 0.00% | 99.96% | 0.01% | 100.00% | 0.01% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 99.97% | 0.00% | 0.00% | 0.01% | 0.02% | 0.01% | 99.95% | 0.00% | 0.01% |
| nogRNA-G1333spilt-KKH-Cas9-G1333-C and dSpCas9-G1333-N | T | 0.01% | 0.01% | 0.00% | 0.02% | 99.95% | 0.01% | 0.02% | 0.00% | 99.96% |
| nogRNA-G1333spilt-KKH-Cas9-G1333-C and dSpCas9-G1333-N | C | 0.00% | 0.00% | 100.00% | 99.96% | 0.03% | 0.00% | 0.00% | 0.00% | 0.02% |
| nogRNA-G1333spilt-KKH-Cas9-G1333-C and dSpCas9-G1333-N | G | 0.02% | 99.99% | 0.00% | 0.00% | 0.00% | 99.98% | 0.01% | 99.99% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-G1371spilt-KKH-Cas9-G1371-N and dSpCas9-G1371-C | A | 99.96% | 0.02% | 0.00% | 0.00% | 0.00% | 0.01% | 99.98% | 0.00% | 0.01% |
| nogRNA-G1371spilt-KKH-Cas9-G1371-N and dSpCas9-G1371-C | T | 0.01% | 0.00% | 0.00% | 0.01% | 99.98% | 0.01% | 0.00% | 0.00% | 99.97% |
| nogRNA-G1371spilt-KKH-Cas9-G1371-N and dSpCas9-G1371-C | C | 0.01% | 0.00% | 100.00% | 99.98% | 0.01% | 0.00% | 0.00% | 0.00% | 0.00% |
| nogRNA-G1371spilt-KKH-Cas9-G1371-N and dSpCas9-G1371-C | G | 0.02% | 99.98% | 0.00% | 0.00% | 0.01% | 99.98% | 0.02% | 100.00% | 0.02% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 99.99% | 0.01% | 0.00% | 0.00% | 0.00% | 0.00% | 99.96% | 0.01% | 0.00% |
| nogRNA-G1371spilt-KKH-Cas9-G1371-C and dSpCas9-G1371-N | T | 0.00% | 0.01% | 0.01% | 0.02% | 99.96% | 0.01% | 0.01% | 0.02% | 99.95% |
| nogRNA-G1371spilt-KKH-Cas9-G1371-C and dSpCas9-G1371-N | C | 0.00% | 0.00% | 99.98% | 99.98% | 0.03% | 0.00% | 0.00% | 0.00% | 0.02% |
| nogRNA-G1371spilt-KKH-Cas9-G1371-C and dSpCas9-G1371-N | G | 0.01% | 99.98% | 0.01% | 0.00% | 0.00% | 99.98% | 0.02% | 99.97% | 0.01% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.01% | 0.01% | 0.01% | 0.01% |
| nogRNA-G1397spilt-KKH-Cas9-G1397-N and dSpCas9-G1397-C | A | 99.98% | 0.00% | 0.01% | 0.01% | 0.00% | 0.00% | 99.83% | 0.00% | 0.00% |
| nogRNA-G1397spilt-KKH-Cas9-G1397-N and dSpCas9-G1397-C | T | 0.01% | 0.01% | 0.00% | 0.00% | 99.83% | 0.00% | 0.00% | 0.00% | 99.84% |
| nogRNA-G1397spilt-KKH-Cas9-G1397-N and dSpCas9-G1397-C | C | 0.00% | 0.00% | 99.85% | 99.85% | 0.02% | 0.00% | 0.01% | 0.00% | 0.00% |
| nogRNA-G1397spilt-KKH-Cas9-G1397-N and dSpCas9-G1397-C | G | 0.01% | 99.99% | 0.01% | 0.00% | 0.00% | 99.86% | 0.02% | 99.86% | 0.01% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.13% | 0.13% | 0.14% | 0.14% | 0.14% | 0.14% | 0.14% |
| nogRNA-G1397spilt-KKH-Cas9-G1397-C and dSpCas9-G1397-N | A | 99.98% | 0.01% | 0.00% | 0.00% | 0.01% | 0.01% | 99.96% | 0.01% | 0.01% |
| nogRNA-G1397spilt-KKH-Cas9-G1397-C and dSpCas9-G1397-N | T | 0.00% | 0.01% | 0.01% | 0.02% | 99.96% | 0.01% | 0.00% | 0.00% | 99.97% |
| nogRNA-G1397spilt-KKH-Cas9-G1397-C and dSpCas9-G1397-N | C | 0.00% | 0.00% | 99.99% | 99.98% | 0.02% | 0.00% | 0.01% | 0.00% | 0.02% |
| nogRNA-G1397spilt-KKH-Cas9-G1397-C and dSpCas9-G1397-N | G | 0.02% | 99.99% | 0.00% | 0.00% | 0.00% | 99.98% | 0.02% | 99.99% | 0.01% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | A | 99.96% | 0.02% | 0.00% | 0.01% | 0.00% | 0.01% | 99.96% | 0.00% | 0.01% |
| nogRNA-N1357spilt-KKH-Cas9-N1357-N and dSpCas9-N1357-C | T | 0.01% | 0.00% | 0.00% | 0.00% | 99.98% | 0.01% | 0.00% | 0.00% | 99.96% |

TABLE 10C-continued

| No gRNA | | | | | | | | | | |
|---|---|---|---|---|---|---|---|---|---|---|
| nogRNA-N1357spilt-KKH-Cas9-N1357-N and dSpCas9-N1357-C | C | 0.01% | 0.00% | 100.00% | 99.98% | 0.01% | 0.00% | 0.00% | 0.00% | 0.01% |
| nogRNA-N1357spilt-KKH-Cas9-N1357-N and dSpCas9-N1357-C | G | 0.02% | 99.98% | 0.00% | 0.00% | 0.00% | 99.97% | 0.03% | 99.99% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 99.92% | 0.01% | 0.00% | 0.00% | 0.00% | 0.01% | 99.93% | 0.01% | 0.01% |
| nogRNA-N1357spilt-KKH-Cas9-N1357-C and dSpCas9-N1357-N | T | 0.00% | 0.01% | 0.01% | 0.00% | 99.99% | 0.02% | 0.01% | 0.01% | 99.97% |
| nogRNA-N1357spilt-KKH-Cas9-N1357-C and dSpCas9-N1357-N | C | 0.05% | 0.00% | 99.99% | 10.000% | 0.01% | 0.00% | 0.04% | 0.00% | 0.02% |
| nogRNA-N1357spilt-KKH-Cas9-N1357-C and dSpCas9-N1357-N | G | 0.03% | 99.99% | 0.00% | 0.00% | 0.00% | 99.97% | 0.02% | 99.99% | 0.01% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 99.98% | 0.01% | 0.00% | 0.00% | 0.00% | 0.01% | 99.96% | 0.00% | 0.01% |
| nogRNA-N1387spilt-KKH-Cas9-N1387-N and dSpCas9-N1387-C | T | 0.00% | 0.00% | 0.00% | 0.00% | 99.94% | 0.01% | 0.00% | 0.00% | 99.96% |
| nogRNA-N1387spilt-KKH-Cas9-N1387-N and dSpCas9-N1387-C | C | 0.00% | 0.01% | 99.98% | 99.99% | 0.04% | 0.00% | 0.00% | 0.00% | 0.01% |
| nogRNA-N1387spilt-KKH-Cas9-N1387-N and dSpCas9-N1387-C | G | 0.02% | 99.97% | 0.00% | 0.00% | 0.00% | 99.97% | 0.02% | 99.98% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.01% | 0.01% | 0.01% | 0.01% | 0.01% |
| nogRNA-N1387spilt-KKH-Cas9-N1387-C and dSpCas9-N1387-N | A | 99.98% | 0.00% | 0.01% | 0.00% | 0.01% | 0.02% | 99.97% | 0.00% | 0.00% |
| nogRNA-N1387spilt-KKH-Cas9-N1387-C and dSpCas9-N1387-N | T | 0.00% | 0.00% | 0.01% | 0.01% | 99.96% | 0.01% | 0.00% | 0.00% | 99.96% |
| nogRNA-N1387spilt-KKH-Cas9-N1387-C and dSpCas9-N1387-N | C | 0.00% | 0.00% | 99.98% | 99.99% | 0.03% | 0.00% | 0.01% | 0.00% | 0.04% |
| nogRNA-N1387spilt-KKH-Cas9-N1387-C and dSpCas9-N1387-N | G | 0.02% | 100.00% | 0.00% | 0.00% | 0.00% | 99.97% | 0.02% | 100.00% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% | 0.00% |

| Batch | Nucleotide | G | T | T | G | A | G | G | C |
|---|---|---|---|---|---|---|---|---|---|
| nogRNA-A1343spilt-KKH-Cas9-A1343-N and dSpCas9-A1343-C | A | 0.00% | 0.01% | 0.00% | 0.02% | 99.98% | 0.03% | 0.02% | 0.00% |
| nogRNA-A1343spilt-KKH-Cas9-A1343-N and dSpCas9-A1343-C | T | 0.01% | 99.97% | 99.98% | 0.01% | 0.00% | 0.01% | 0.00% | 0.01% |
| nogRNA-A1343spilt-KKH-Cas9-A1343-N and dSpCas9-A1343-C | C | 0.01% | 0.00% | 0.01% | 0.00% | 0.01% | 0.00% | 0.00% | 99.98% |

TABLE 10C-continued

| No gRNA | | | | | | | | | |
|---|---|---|---|---|---|---|---|---|---|
| nogRNA-A1343spilt-KKH-Cas9-A1343-N and dSpCas9-A1343-C | G | 99.98% | 0.02% | 0.01% | 99.97% | 0.01% | 99.95% | 99.97% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.01% | 0.00% | 0.00% |
| nogRNA-A1343spilt-KKH-Cas9-A1343-C and dSpCas9-A1343-N | A | 0.00% | 0.00% | 0.00% | 0.01% | 99.97% | 0.02% | 0.01% | 0.00% |
| nogRNA-A1343spilt-KKH-Cas9-A1343-C and dSpCas9-A1343-N | T | 0.01% | 99.99% | 99.98% | 0.00% | 0.00% | 0.00% | 0.00% | 0.03% |
| nogRNA-A1343spilt-KKH-Cas9-A1343-C and dSpCas9-A1343-N | C | 0.00% | 0.00% | 0.01% | 0.00% | 0.02% | 0.00% | 0.00% | 99.97% |
| nogRNA-A1343spilt-KKH-Cas9-A1343-C and dSpCas9-A1343-N | G | 99.98% | 0.01% | 0.01% | 99.98% | 0.00% | 99.97% | 99.98% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 0.01% | 0.01% | 0.02% | 99.97% | 0.03% | 0.01% | 0.00% |
| nogRNA-G1322spilt-KKH-Cas9-G1322-N and dSpCas9-G1322-C | T | 0.01% | 99.97% | 99.99% | 0.00% | 0.01% | 0.01% | 0.01% | 0.01% |
| nogRNA-G1322spilt-KKH-Cas9-G1322-N and dSpCas9-G1322-C | C | 0.00% | 0.01% | 0.00% | 0.00% | 0.00% | 0.00% | 0.00% | 99.98% |
| nogRNA-G1322spilt-KKH-Cas9-G1322-N and dSpCas9-G1322-C | G | 99.99% | 0.01% | 0.00% | 99.96% | 0.02% | 99.96% | 99.98% | 0.01% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.01% | 0.00% | 0.00% | 0.00% | 0.00% |
| nogRNA-G1322spilt-KKH-Cas9-G1322-C and dSpCas9-G1322-N | A | 0.00% | 0.00% | 0.00% | 0.01% | 99.95% | 0.01% | 0.02% | 0.01% |
| nogRNA-G1322spilt-KKH-Cas9-G1322-C and dSpCas9-G1322-N | T | 0.02% | 99.95% | 99.96% | 0.00% | 0.00% | 0.01% | 0.01% | 0.02% |
| nogRNA-G1322spilt-KKH-Cas9-G1322-C and dSpCas9-G1322-N | C | 0.00% | 0.03% | 0.03% | 0.00% | 0.01% | 0.00% | 0.00% | 99.97% |
| nogRNA-G1322spilt-KKH-Cas9-G1322-C and dSpCas9-G1322-N | G | 99.97% | 0.02% | 0.00% | 99.97% | 0.01% | 99.96% | 99.97% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.01% | 0.02% | 0.02% | 0.00% | 0.00% |
| nogRNA-G1333spilt-KKH-Cas9-G1333-N and dSpCas9-G1333-C | A | 0.00% | 0.01% | 0.00% | 0.02% | 99.98% | 0.01% | 0.01% | 0.00% |
| nogRNA-G1333spilt-KKH-Cas9-G1333-N and dSpCas9-G1333-C | T | 0.01% | 99.96% | 99.99% | 0.00% | 0.00% | 0.00% | 0.00% | 0.01% |
| nogRNA-G1333spilt-KKH-Cas9-G1333-N and dSpCas9-G1333-C | C | 0.00% | 0.01% | 0.01% | 0.00% | 0.00% | 0.00% | 0.00% | 99.99% |
| nogRNA-G1333spilt-KKH-Cas9-G1333-N and dSpCas9-G1333-C | G | 99.98% | 0.02% | 0.00% | 99.95% | 0.01% | 99.98% | 99.98% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |

TABLE 10C-continued

| | | No gRNA | | | | | | | |
|---|---|---|---|---|---|---|---|---|---|
| nogRNA-G1333spilt-KKH-Cas9-G1333-N and dSpCas9-G1333-C | — | 0.00% | 0.00% | 0.00% | 0.02% | 0.00% | 0.00% | 0.00% | 0.00% |
| nogRNA-G1333spilt-KKH-Cas9-G1333-C and dSpCas9-G1333-N | A | 0.00% | 0.01% | 0.01% | 0.01% | 99.95% | 0.03% | 0.01% | 0.00% |
| nogRNA-G1333spilt-KKH-Cas9-G1333-C and dSpCas9-G1333-N | T | 0.00% | 99.96% | 99.97% | 0.01% | 0.02% | 0.02% | 0.00% | 0.01% |
| nogRNA-G1333spilt-KKH-Cas9-G1333-C and dSpCas9-G1333-N | C | 0.00% | 0.02% | 0.02% | 0.00% | 0.01% | 0.00% | 0.01% | 99.98% |
| nogRNA-G1333spilt-KKH-Cas9-G1333-C and dSpCas9-G1333-N | G | 99.99% | 0.00% | 0.00% | 99.98% | 0.02% | 99.95% | 99.97% | 0.01% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.02% | 0.00% | 0.00% | 0.02% | 99.95% | 0.02% | 0.00% | 0.01% |
| nogRNA-G1371spilt-KKH-Cas9-G1371-N and dSpCas9-G1371-C | T | 0.02% | 99.98% | 99.99% | 0.00% | 0.01% | 0.00% | 0.01% | 0.02% |
| nogRNA-G1371spilt-KKH-Cas9-G1371-N and dSpCas9-G1371-C | C | 0.00% | 0.02% | 0.01% | 0.00% | 0.00% | 0.00% | 0.00% | 99.97% |
| nogRNA-G1371spilt-KKH-Cas9-G1371-N and dSpCas9-G1371-C | G | 99.97% | 0.00% | 0.00% | 99.97% | 0.04% | 99.97% | 99.99% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.01% | 0.01% | 0.01% | 0.00% | 0.00% |
| nogRNA-G1371spilt-KKH-Cas9-G1371-C and dSpCas9-G1371-N | A | 0.00% | 0.01% | 0.00% | 0.01% | 99.95% | 0.01% | 0.01% | 0.00% |
| nogRNA-G1371spilt-KKH-Cas9-G1371-C and dSpCas9-G1371-N | T | 0.00% | 99.95% | 99.98% | 0.00% | 0.01% | 0.01% | 0.01% | 0.01% |
| nogRNA-G1371spilt-KKH-Cas9-G1371-C and dSpCas9-G1371-N | C | 0.00% | 0.02% | 0.01% | 0.00% | 0.00% | 0.00% | 0.00% | 99.98% |
| nogRNA-G1371spilt-KKH-Cas9-G1371-C and dSpCas9-G1371-N | G | 99.99% | 0.01% | 0.00% | 99.97% | 0.02% | 99.97% | 99.98% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.01% | 0.01% | 0.01% | 0.01% | 0.01% | 0.01% | 0.01% | 0.01% |
| nogRNA-G1397spilt-KKH-Cas9-G1397-N and dSpCas9-G1397-C | A | 0.02% | 0.01% | 0.00% | 0.00% | 99.85% | 0.01% | 0.01% | 0.00% |
| nogRNA-G1397spilt-KKH-Cas9-G1397-N and dSpCas9-G1397-C | T | 0.01% | 99.83% | 99.83% | 0.00% | 0.00% | 0.00% | 0.01% | 0.00% |
| nogRNA-G1397spilt-KKH-Cas9-G1397-N and dSpCas9-G1397-C | C | 0.00% | 0.01% | 0.02% | 0.00% | 0.00% | 0.00% | 0.00% | 99.76% |
| nogRNA-G1397spilt-KKH-Cas9-G1397-N and dSpCas9-G1397-C | G | 99.83% | 0.00% | 0.00% | 99.85% | 0.00% | 99.75% | 99.75% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.14% | 0.14% | 0.14% | 0.14% | 0.14% | 0.23% | 0.23% | 0.23% |
| nogRNA-G1397spilt-KKH-Cas9-G1397-C and dSpCas9-G1397-N | A | 0.01% | 0.01% | 0.00% | 0.01% | 99.97% | 0.01% | 0.00% | 0.00% |

TABLE 10C-continued

| | | No gRNA | | | | | | | |
|---|---|---|---|---|---|---|---|---|---|
| nogRNA-G1397spilt-KKH-Cas9-G1397-C and dSpCas9-G1397-N | T | 0.01% | 99.97% | 99.98% | 0.00% | 0.01% | 0.01% | 0.00% | 0.01% |
| nogRNA-G1397spilt-KKH-Cas9-G1397-C and dSpCas9-G1397-N | C | 0.00% | 0.01% | 0.02% | 0.00% | 0.01% | 0.00% | 0.01% | 99.98% |
| nogRNA-G1397spilt-KKH-Cas9-G1397-C and dSpCas9-G1397-N | G | 99.98% | 0.01% | 0.00% | 99.98% | 0.01% | 99.97% | 99.98% | 0.01% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.01% | 0.01% | 0.01% | 0.00% | 0.00% |
| nogRNA-N1357spilt-KKH-Cas9-N1357-N and dSpCas9-N1357-C | A | 0.01% | 0.01% | 0.00% | 0.02% | 99.97% | 0.01% | 0.01% | 0.00% |
| nogRNA-N1357spilt-KKH-Cas9-N1357-N and dSpCas9-N1357-C | T | 0.01% | 99.97% | 99.99% | 0.01% | 0.01% | 0.02% | 0.00% | 0.01% |
| nogRNA-N1357spilt-KKH-Cas9-N1357-N and dSpCas9-N1357-C | C | 0.00% | 0.01% | 0.01% | 0.00% | 0.00% | 0.00% | 0.00% | 99.98% |
| nogRNA-N1357spilt-KKH-Cas9-N1357-N and dSpCas9-N1357-C | G | 99.98% | 0.01% | 0.00% | 99.97% | 0.01% | 99.97% | 99.99% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.01% | 0.01% | 0.01% | 0.00% | 0.00% |
| nogRNA-N1357spilt-KKH-Cas9-N1357-C and dSpCas9-N1357-N | A | 0.01% | 0.01% | 0.00% | 0.02% | 99.95% | 0.01% | 0.00% | 0.00% |
| nogRNA-N1357spilt-KKH-Cas9-N1357-C and dSpCas9-N1357-N | T | 0.01% | 99.98% | 99.98% | 0.00% | 0.00% | 0.02% | 0.01% | 0.01% |
| nogRNA-N1357spilt-KKH-Cas9-N1357-C and dSpCas9-N1357-N | C | 0.00% | 0.01% | 0.02% | 0.00% | 0.02% | 0.00% | 0.00% | 99.98% |
| nogRNA-N1357spilt-KKH-Cas9-N1357-C and dSpCas9-N1357-N | G | 99.99% | 0.01% | 0.00% | 99.97% | 0.02% | 99.96% | 99.99% | 0.01% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.01% | 0.01% | 0.01% | 0.00% | 0.00% |
| nogRNA-N1387spilt-KKH-Cas9-N1387-N and dSpCas9-N1387-C | A | 0.00% | 0.00% | 0.01% | 0.02% | 99.95% | 0.01% | 0.02% | 0.00% |
| nogRNA-N1387spilt-KKH-Cas9-N1387-N and dSpCas9-N1387-C | T | 0.01% | 99.96% | 99.96% | 0.00% | 0.01% | 0.01% | 0.01% | 0.02% |
| nogRNA-N1387spilt-KKH-Cas9-N1387-N and dSpCas9-N1387-C | C | 0.00% | 0.02% | 0.01% | 0.00% | 0.00% | 0.01% | 0.00% | 99.97% |
| nogRNA-N1387spilt-KKH-Cas9-N1387-N and dSpCas9-N1387-C | G | 99.97% | 0.00% | 0.01% | 99.96% | 0.02% | 99.96% | 99.94% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.01% | 0.02% | 0.01% | 0.01% | 0.02% | 0.01% |
| nogRNA-N1387spilt-KKH-Cas9-N1387-C and dSpCas9-N1387-N | A | 0.01% | 0.01% | 0.00% | 0.01% | 99.96% | 0.00% | 0.01% | 0.01% |
| nogRNA-N1387spilt-KKH-Cas9-N1387-C and dSpCas9-N1387-N | T | 0.00% | 99.96% | 99.98% | 0.00% | 0.01% | 0.01% | 0.00% | 0.00% |
| nogRNA-N1387spilt-KKH-Cas9-N1387-C and dSpCas9-N1387-N | C | 0.00% | 0.01% | 0.02% | 0.00% | 0.01% | 0.00% | 0.00% | 99.96% |

TABLE 10C-continued

| No gRNA | | | | | | | | | |
|---|---|---|---|---|---|---|---|---|---|
| nogRNA-N1387spilt-KKH-Cas9-N1387-C and dSpCas9-N1387-N | G | 99.99% | 0.01% | 0.00% | 99.99% | 0.01% | 99.99% | 99.98% | 0.02% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% |

| Batch | Nucleotide | C | C | C | A | G | T | G |
|---|---|---|---|---|---|---|---|---|
| nogRNA-A1343spilt-KKH-Cas9-A1343-N and dSpCas9-A1343-C | A | 0.00% | 0.00% | 0.00% | 99.97% | 0.01% | 0.00% | 0.00% |
| nogRNA-A1343spilt-KKH-Cas9-A1343-N and dSpCas9-A1343-C | T | 0.03% | 0.01% | 0.01% | 0.00% | 0.00% | 99.98% | 0.00% |
| nogRNA-A1343spilt-KKH-Cas9-A1343-N and dSpCas9-A1343-C | C | 99.97% | 99.98% | 99.96% | 0.00% | 0.00% | 0.01% | 0.00% |
| nogRNA-A1343spilt-KKH-Cas9-A1343-N and dSpCas9-A1343-C | G | 0.00% | 0.00% | 0.00% | 0.02% | 99.98% | 0.01% | 99.99% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.03% | 0.00% | 0.00% | 0.00% | 0.00% |
| nogRNA-A1343spilt-KKH-Cas9-A1343-C and dSpCas9-A1343-N | A | 0.00% | 0.01% | 0.00% | 99.95% | 0.00% | 0.00% | 0.02% |
| nogRNA-A1343spilt-KKH-Cas9-A1343-C and dSpCas9-A1343-N | T | 0.01% | 0.01% | 0.00% | 0.00% | 0.00% | 99.95% | 0.01% |
| nogRNA-A1343spilt-KKH-Cas9-A1343-C and dSpCas9-A1343-N | C | 99.99% | 99.97% | 99.99% | 0.04% | 0.00% | 0.02% | 0.00% |
| nogRNA-A1343spilt-KKH-Cas9-A1343-C and dSpCas9-A1343-N | G | 0.00% | 0.00% | 0.00% | 0.02% | 100.00% | 0.02% | 99.97% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.01% | 0.00% | 0.00% | 0.00% | 0.00% |
| nogRNA-G1322spilt-KKH-Cas9-G1322-N and dSpCas9-G1322-C | A | 0.00% | 0.00% | 0.01% | 99.94% | 0.00% | 0.01% | 0.01% |
| nogRNA-G1322spilt-KKH-Cas9-G1322-N and dSpCas9-G1322-C | T | 0.00% | 0.02% | 0.01% | 0.01% | 0.00% | 99.96% | 0.01% |
| nogRNA-G1322spilt-KKH-Cas9-G1322-N and dSpCas9-G1322-C | C | 99.99% | 99.98% | 99.93% | 0.01% | 0.00% | 0.01% | 0.01% |
| nogRNA-G1322spilt-KKH-Cas9-G1322-N and dSpCas9-G1322-C | G | 0.00% | 0.00% | 0.00% | 0.05% | 10.000% | 0.01% | 99.97% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.05% | 0.00% | 0.00% | 0.00% | 0.00% |
| nogRNA-G1322spilt-KKH-Cas9-G1322-C and dSpCas9-G1322-N | A | 0.00% | 0.01% | 0.01% | 99.96% | 0.00% | 0.01% | 0.02% |
| nogRNA-G1322spilt-KKH-Cas9-G1322-C and dSpCas9-G1322-N | T | 0.00% | 0.01% | 0.00% | 0.00% | 0.00% | 99.95% | 0.01% |
| nogRNA-G1322spilt-KKH-Cas9-G1322-C and dSpCas9-G1322-N | C | 10.000% | 99.97% | 99.95% | 0.01% | 0.00% | 0.03% | 0.00% |
| nogRNA-G1322spilt-KKH-Cas9-G1322-C and dSpCas9-G1322-N | G | 0.00% | 0.00% | 0.00% | 0.02% | 99.99% | 0.00% | 99.97% |

TABLE 10C-continued

| No gRNA | | | | | | | | |
|---|---|---|---|---|---|---|---|---|
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.01% | 0.03% | 0.00% | 0.00% | 0.00% | 0.00% |
| nogRNA-G1333spilt-KKH-Cas9-G1333-N and dSpCas9-G1333-C | A | 0.00% | 0.01% | 0.01% | 99.94% | 0.00% | 0.00% | 0.02% |
| nogRNA-G1333spilt-KKH-Cas9-G1333-N and dSpCas9-G1333-C | T | 0.00% | 0.01% | 0.01% | 0.01% | 0.00% | 99.95% | 0.00% |
| nogRNA-G1333spilt-KKH-Cas9-G1333-N and dSpCas9-G1333-C | C | 99.99% | 99.96% | 99.94% | 0.01% | 0.00% | 0.02% | 0.00% |
| nogRNA-G1333spilt-KKH-Cas9-G1333-N and dSpCas9-G1333-C | G | 0.00% | 0.00% | 0.01% | 0.04% | 100.00% | 0.02% | 99.97% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.01% | 0.03% | 0.00% | 0.00% | 0.00% | 0.00% |
| nogRNA-G1333spilt-KKH-Cas9-G1333-C and dSpCas9-G1333-N | A | 0.00% | 0.02% | 0.00% | 99.97% | 0.01% | 0.00% | 0.01% |
| nogRNA-G1333spilt-KKH-Cas9-G1333-C and dSpCas9-G1333-N | T | 0.00% | 0.02% | 0.02% | 0.00% | 0.01% | 99.97% | 0.00% |
| nogRNA-G1333spilt-KKH-Cas9-G1333-C and dSpCas9-G1333-N | C | 99.99% | 99.96% | 99.94% | 0.01% | 0.00% | 0.03% | 0.00% |
| nogRNA-G1333spilt-KKH-Cas9-G1333-C and dSpCas9-G1333-N | G | 0.00% | 0.00% | 0.01% | 0.02% | 99.97% | 0.00% | 99.98% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.04% | 0.00% | 0.00% | 0.00% | 0.00% |
| nogRNA-G1371spilt-KKH-Cas9-G1371-N and dSpCas9-G1371-C | A | 0.00% | 0.00% | 0.00% | 99.96% | 0.00% | 0.01% | 0.03% |
| nogRNA-G1371spilt-KKH-Cas9-G1371-N and dSpCas9-G1371-C | T | 0.00% | 0.00% | 0.01% | 0.01% | 0.00% | 99.98% | 0.01% |
| nogRNA-G1371spilt-KKH-Cas9-G1371-N and dSpCas9-G1371-C | C | 100.00% | 99.98% | 99.96% | 0.00% | 0.00% | 0.01% | 0.00% |
| nogRNA-G1371spilt-KKH-Cas9-G1371-N and dSpCas9-G1371-C | G | 0.00% | 0.01% | 0.00% | 0.03% | 99.99% | 0.01% | 99.96% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.02% | 0.00% | 0.00% | 0.00% | 0.00% |
| nogRNA-G1371spilt-KKH-Cas9-G1371-C and dSpCas9-G1371-N | A | 0.01% | 0.01% | 0.01% | 99.96% | 0.01% | 0.01% | 0.01% |
| nogRNA-G1371spilt-KKH-Cas9-G1371-C and dSpCas9-G1371-N | T | 0.01% | 0.01% | 0.02% | 0.01% | 0.00% | 99.95% | 0.01% |
| nogRNA-G1371spilt-KKH-Cas9-G1371-C and dSpCas9-G1371-N | C | 99.96% | 99.97% | 99.95% | 0.00% | 0.00% | 0.01% | 0.00% |
| nogRNA-G1371spilt-KKH-Cas9-G1371-C and dSpCas9-G1371-N | G | 0.01% | 0.00% | 0.00% | 0.02% | 99.99% | 0.02% | 99.97% |
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.01% | 0.01% | 0.02% | 0.01% | 0.01% | 0.01% | 0.01% |

TABLE 10C-continued

| No gRNA | | | | | | | | |
|---|---|---|---|---|---|---|---|---|
| nogRNA-G1397spilt-KKH-Cas9-G1397-N and dSpCas9-G1397-C | A | 0.00% | 0.01% | 0.01% | 99.74% | 0.01% | 0.01% | 0.01% |
| nogRNA-G1397spilt-KKH-Cas9-G1397-N and dSpCas9-G1397-C | T | 0.01% | 0.00% | 0.00% | 0.00% | 0.01% | 99.74% | 0.03% |
| nogRNA-G1397spilt-KKH-Cas9-G1397-N and dSpCas9-G1397-C | C | 99.75% | 99.76% | 99.72% | 0.00% | 0.00% | 0.01% | 0.00% |
| nogRNA-G1397spilt-KKH-Cas9-G1397-N and dSpCas9-G1397-C | G | 0.00% | 0.00% | 0.00% | 0.02% | 99.75% | 0.01% | 99.73% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.23% | 0.23% | 0.26% | 0.23% | 0.23% | 0.23% | 0.23% |
| nogRNA-G1397spilt-KKH-Cas9-G1397-C and dSpCas9-G1397-N | A | 0.00% | 0.00% | 0.01% | 99.96% | 0.00% | 0.00% | 0.01% |
| nogRNA-G1397spilt-KKH-Cas9-G1397-C and dSpCas9-G1397-N | T | 0.00% | 0.02% | 0.01% | 0.00% | 0.00% | 99.94% | 0.01% |
| nogRNA-G1397spilt-KKH-Cas9-G1397-C and dSpCas9-G1397-N | C | 100.00% | 99.97% | 99.95% | 0.00% | 0.00% | 0.02% | 0.00% |
| nogRNA-G1397spilt-KKH-Cas9-G1397-C and dSpCas9-G1397-N | G | 0.00% | 0.00% | 0.00% | 0.03% | 99.98% | 0.02% | 99.96% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.03% | 0.01% | 0.01% | 0.01% | 0.01% |
| nogRNA-N1357spilt-KKH-Cas9-N1357-N and dSpCas9-N1357-C | A | 0.01% | 0.00% | 0.00% | 99.98% | 0.03% | 0.01% | 0.02% |
| nogRNA-N1357spilt-KKH-Cas9-N1357-N and dSpCas9-N1357-C | T | 0.01% | 0.01% | 0.01% | 0.00% | 0.00% | 99.95% | 0.02% |
| nogRNA-N1357spilt-KKH-Cas9-N1357-N and dSpCas9-N1357-C | C | 99.98% | 99.98% | 99.95% | 0.00% | 0.00% | 0.02% | 0.01% |
| nogRNA-N1357spilt-KKH-Cas9-N1357-N and dSpCas9-N1357-C | G | 0.00% | 0.00% | 0.00% | 0.02% | 99.97% | 0.02% | 99.96% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.04% | 0.00% | 0.00% | 0.00% | 0.00% |
| nogRNA-N1357spilt-KKH-Cas9-N1357-C and dSpCas9-N1357-N | A | 0.02% | 0.00% | 0.00% | 99.94% | 0.01% | 0.01% | 0.01% |
| nogRNA-N1357spilt-KKH-Cas9-N1357-C and dSpCas9-N1357-N | T | 0.00% | 0.02% | 0.02% | 0.01% | 0.00% | 99.97% | 0.01% |
| nogRNA-N1357spilt-KKH-Cas9-N1357-C and dSpCas9-N1357-N | C | 99.98% | 99.97% | 99.98% | 0.04% | 0.00% | 0.02% | 0.01% |
| nogRNA-N1357spilt-KKH-Cas9-N1357-C and dSpCas9-N1357-N | G | 0.00% | 0.01% | 0.00% | 0.01% | 99.99% | 0.00% | 99.98% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.01% | 0.00% | 0.00% | 0.00% | 0.00% |
| nogRNA-N1387spilt-KKH-Cas9-N1387-N and dSpCas9-N1387-C | A | 0.00% | 0.00% | 0.01% | 99.96% | 0.00% | 0.01% | 0.01% |
| nogRNA-N1387spilt-KKH-Cas9-N1387-N and dSpCas9-N1387-C | T | 0.02% | 0.01% | 0.04% | 0.00% | 0.00% | 99.96% | 0.02% |

TABLE 10C-continued

| | | No gRNA | | | | | | |
|---|---|---|---|---|---|---|---|---|
| nogRNA-N1387spilt-KKH-Cas9-N1387-N and dSpCas9-N1387-C | C | 99.97% | 99.97% | 99.89% | 0.01% | 0.00% | 0.02% | 0.00% |
| nogRNA-N1387spilt-KKH-Cas9-N1387-N and dSpCas9-N1387-C | G | 0.00% | 0.00% | 0.01% | 0.02% | 99.99% | 0.00% | 99.96% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.04% | 0.01% | 0.01% | 0.01% | 0.01% |
| nogRNA-N1387spilt-KKH-Cas9-N1387-C and dSpCas9-N1387-N | A | 0.00% | 0.00% | 0.01% | 99.95% | 0.00% | 0.01% | 0.00% |
| nogRNA-N1387spilt-KKH-Cas9-N1387-C and dSpCas9-N1387-N | T | 0.01% | 0.00% | 0.02% | 0.01% | 0.01% | 99.96% | 0.01% |
| nogRNA-N1387spilt-KKH-Cas9-N1387-C and dSpCas9-N1387-N | C | 99.98% | 99.98% | 99.92% | 0.01% | 0.00% | 0.01% | 0.00% |
| nogRNA-N1387spilt-KKH-Cas9-N1387-C and dSpCas9-N1387-N | G | 0.00% | 0.00% | 0.00% | 0.02% | 99.97% | 0.00% | 99.97% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.05% | 0.01% | 0.01% | 0.01% | 0.01% |

| Batch | Nucleotide | G | C | T | G | C | T | C | T | G |
|---|---|---|---|---|---|---|---|---|---|---|
| nogRNA-A1343spilt-KKH-Cas9-A1343-N and dSpCas9-A1343-C | A | 0.01% | 0.01% | 0.00% | 0.01% | 0.01% | 0.00% | 0.00% | 0.00% | 0.02% |
| nogRNA-A1343spilt-KKH-Cas9-A1343-N and dSpCas9-A1343-C | T | 0.00% | 0.01% | 99.98% | 0.00% | 0.00% | 99.98% | 0.00% | 99.98% | 0.00% |
| nogRNA-A1343spilt-KKH-Cas9-A1343-N and dSpCas9-A1343-C | C | 0.01% | 99.98% | 0.02% | 0.00% | 99.99% | 0.01% | 100.00% | 0.02% | 0.01% |
| nogRNA-A1343spilt-KKH-Cas9-A1343-N and dSpCas9-A1343-C | G | 99.98% | 0.00% | 0.00% | 99.99% | 0.00% | 0.01% | 0.00% | 0.00% | 99.97% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.01% | 0.00% | 0.01% | 0.00% | 0.00% | 0.00% | 0.00% | 0.00% | 0.01% |
| nogRNA-A1343spilt-KKH-Cas9-A1343-C and dSpCas9-A1343-N | T | 0.00% | 0.01% | 99.96% | 0.01% | 0.00% | 99.99% | 0.00% | 99.98% | 0.01% |
| nogRNA-A1343spilt-KKH-Cas9-A1343-C and dSpCas9-A1343-N | C | 0.00% | 99.99% | 0.03% | 0.00% | 99.99% | 0.00% | 100.00% | 0.02% | 0.00% |
| nogRNA-A1343spilt-KKH-Cas9-A1343-C and dSpCas9-A1343-N | G | 99.99% | 0.00% | 0.00% | 99.98% | 0.01% | 0.01% | 0.00% | 0.00% | 99.98% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.01% | 0.00% | 0.00% | 0.00% | 0.00% | 0.00% | 0.00% | 0.00% | 0.01% |
| nogRNA-G1322spilt-KKH-Cas9-G1322-N and dSpCas9-G1322-C | T | 0.01% | 0.01% | 99.98% | 0.02% | 0.00% | 99.98% | 0.01% | 99.97% | 0.02% |
| nogRNA-G1322spilt-KKH-Cas9-G1322-N and dSpCas9-G1322-C | C | 0.00% | 99.99% | 0.01% | 0.00% | 99.99% | 0.00% | 99.99% | 0.02% | 0.00% |

TABLE 10C-continued

| No gRNA | | | | | | | | | | |
|---|---|---|---|---|---|---|---|---|---|---|
| nogRNA-G1322spilt-KKH-Cas9-G1322-N and dSpCas9-G1322-C | G | 99.98% | 0.00% | 0.00% | 99.97% | 0.00% | 0.01% | 0.00% | 0.01% | 99.96% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 0.00% | 0.01% | 0.03% | 0.00% | 0.00% | 0.01% | 0.01% | 0.01% |
| nogRNA-G1322spilt-KKH-Cas9-G1322-C and dSpCas9-G1322-N | T | 0.00% | 0.01% | 99.98% | 0.01% | 0.00% | 99.97% | 0.03% | 99.97% | 0.01% |
| nogRNA-G1322spilt-KKH-Cas9-G1322-C and dSpCas9-G1322-N | C | 0.00% | 99.99% | 0.01% | 0.00% | 99.99% | 0.02% | 99.97% | 0.02% | 0.01% |
| nogRNA-G1322spilt-KKH-Cas9-G1322-C and dSpCas9-G1322-N | G | 99.99% | 0.00% | 0.00% | 99.96% | 0.00% | 0.01% | 0.00% | 0.00% | 99.97% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.01% | 0.00% | 0.01% | 0.01% | 0.00% | 0.00% | 0.01% | 0.01% | 0.02% |
| nogRNA-G1333spilt-KKH-Cas9-G1333-N and dSpCas9-G1333-C | T | 0.01% | 0.00% | 99.98% | 0.02% | 0.01% | 99.97% | 0.01% | 99.98% | 0.00% |
| nogRNA-G1333spilt-KKH-Cas9-G1333-N and dSpCas9-G1333-C | C | 0.00% | 99.99% | 0.01% | 0.00% | 99.99% | 0.01% | 99.97% | 0.00% | 0.00% |
| nogRNA-G1333spilt-KKH-Cas9-G1333-N and dSpCas9-G1333-C | G | 99.98% | 0.00% | 0.00% | 99.97% | 0.00% | 0.01% | 0.00% | 0.00% | 99.97% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.01% | 0.00% | 0.00% | 0.01% | 0.00% | 0.00% | 0.00% | 0.00% | 0.01% |
| nogRNA-G1333spilt-KKH-Cas9-G1333-C and dSpCas9-G1333-N | T | 0.01% | 0.00% | 99.97% | 0.02% | 0.00% | 99.98% | 0.00% | 99.99% | 0.00% |
| nogRNA-G1333spilt-KKH-Cas9-G1333-C and dSpCas9-G1333-N | C | 0.00% | 100.00% | 0.03% | 0.00% | 99.99% | 0.01% | 100.00% | 0.01% | 0.01% |
| nogRNA-G1333spilt-KKH-Cas9-G1333-C and dSpCas9-G1333-N | G | 99.97% | 0.00% | 0.00% | 99.97% | 0.00% | 0.00% | 0.00% | 0.00% | 99.97% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.01% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.01% | 0.00% | 0.01% | 0.01% | 0.00% | 0.01% | 0.00% | 0.01% | 0.00% |
| nogRNA-G1371spilt-KKH-Cas9-G1371-N and dSpCas9-G1371-C | T | 0.00% | 0.00% | 99.97% | 0.00% | 0.01% | 99.97% | 0.03% | 99.97% | 0.02% |
| nogRNA-G1371spilt-KKH-Cas9-G1371-N and dSpCas9-G1371-C | C | 0.00% | 99.99% | 0.02% | 0.00% | 99.99% | 0.02% | 99.97% | 0.02% | 0.00% |
| nogRNA-G1371spilt-KKH-Cas9-G1371-N and dSpCas9-G1371-C | G | 99.98% | 0.00% | 0.00% | 99.98% | 0.00% | 0.00% | 0.00% | 0.00% | 99.97% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.00% | 0.00% | 0.00% | 0.01% | 0.00% | 0.00% | 0.00% | 0.01% | 0.01% |
| nogRNA-G1371spilt-KKH-Cas9-G1371-C and dSpCas9-G1371-N | T | 0.01% | 0.00% | 99.99% | 0.00% | 0.00% | 99.96% | 0.01% | 99.96% | 0.01% |
| nogRNA-G1371spilt-KKH-Cas9-G1371-C and dSpCas9-G1371-N | C | 0.00% | 99.99% | 0.01% | 0.00% | 99.99% | 0.02% | 99.97% | 0.01% | 0.00% |
| nogRNA-G1371spilt-KKH-Cas9-G1371-C and dSpCas9-G1371-N | G | 99.97% | 0.00% | 0.00% | 99.98% | 0.00% | 0.01% | 0.00% | 0.00% | 99.97% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.01% | 0.01% | 0.01% | 0.01% | 0.01% | 0.01% | 0.01% | 0.01% | 0.01% |
| nogRNA-G1397spilt-KKH-Cas9-G1397-N and dSpCas9-G1397-C | A | 0.00% | 0.01% | 0.01% | 0.03% | 0.00% | 0.00% | 0.00% | 0.00% | 0.01% |
| nogRNA-G1397spilt-KKH-Cas9-G1397-N and dSpCas9-G1397-C | T | 0.00% | 0.00% | 99.70% | 0.00% | 0.00% | 99.70% | 0.01% | 99.70% | 0.01% |
| nogRNA-G1397spilt-KKH-Cas9-G1397-N and dSpCas9-G1397-C | C | 0.00% | 99.71% | 0.01% | 0.00% | 99.72% | 0.01% | 99.71% | 0.02% | 0.00% |
| nogRNA-G1397spilt-KKH-Cas9-G1397-N and dSpCas9-G1397-C | G | 99.76% | 0.00% | 0.00% | 99.69% | 0.00% | 0.01% | 0.00% | 0.00% | 99.70% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.23% | 0.27% | 0.27% | 0.28% | 0.28% | 0.28% | 0.28% | 0.28% | 0.28% |
| nogRNA-G1397spilt-KKH-Cas9-G1397-C and dSpCas9-G1397-N | A | 0.01% | 0.00% | 0.00% | 0.02% | 0.00% | 0.00% | 0.01% | 0.01% | 0.01% |
| nogRNA-G1397spilt-KKH-Cas9-G1397-C and dSpCas9-G1397-N | T | 0.01% | 0.02% | 99.96% | 0.01% | 0.00% | 99.97% | 0.01% | 99.96% | 0.00% |
| nogRNA-G1397spilt-KKH-Cas9-G1397-C and dSpCas9-G1397-N | C | 0.00% | 99.96% | 0.01% | 0.00% | 99.98% | 0.00% | 99.96% | 0.00% | 0.00% |
| nogRNA-G1397spilt-KKH-Cas9-G1397-C and dSpCas9-G1397-N | G | 99.97% | 0.00% | 0.00% | 99.95% | 0.00% | 0.01% | 0.00% | 0.01% | 99.96% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.01% | 0.02% | 0.02% | 0.02% | 0.02% | 0.02% | 0.02% | 0.02% | 0.02% |
| nogRNA-N1357spilt-KKH-Cas9-N1357-N and dSpCas9-N1357-C | A | 0.00% | 0.00% | 0.00% | 0.01% | 0.00% | 0.00% | 0.00% | 0.00% | 0.01% |
| nogRNA-N1357spilt-KKH-Cas9-N1357-N and dSpCas9-N1357-C | T | 0.00% | 0.01% | 99.97% | 0.00% | 0.01% | 99.98% | 0.00% | 99.99% | 0.01% |
| nogRNA-N1357spilt-KKH-Cas9-N1357-N and dSpCas9-N1357-C | C | 0.00% | 99.98% | 0.03% | 0.00% | 99.99% | 0.01% | 100.00% | 0.00% | 0.00% |
| nogRNA-N1357spilt-KKH-Cas9-N1357-N and dSpCas9-N1357-C | G | 99.99% | 0.01% | 0.00% | 99.99% | 0.00% | 0.01% | 0.00% | 0.00% | 99.98% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.02% | 0.00% | 0.00% | 0.02% | 0.00% | 0.00% | 0.01% | 0.01% | 0.01% |

TABLE 10C-continued

| No gRNA | | | | | | | | | | |
|---|---|---|---|---|---|---|---|---|---|---|
| nogRNA-N1357spilt-KKH-Cas9-N1357-C and dSpCas9-N1357-N | T | 0.01% | 0.01% | 99.99% | 0.01% | 0.03% | 99.97% | 0.00% | 99.99% | 0.01% |
| nogRNA-N1357spilt-KKH-Cas9-N1357-C and dSpCas9-N1357-N | C | 0.00% | 99.99% | 0.01% | 0.00% | 99.97% | 0.02% | 99.99% | 0.01% | 0.00% |
| nogRNA-N1357spilt-KKH-Cas9-N1357-C and dSpCas9-N1357-N | G | 99.97% | 0.00% | 0.01% | 99.98% | 0.00% | 0.02% | 0.00% | 0.00% | 99.98% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.00% | 0.01% | 0.00% | 0.01% | 0.01% | 0.02% | 0.00% | 0.01% | 0.02% |
| nogRNA-N1387spilt-KKH-Cas9-N1387-N and dSpCas9-N1387-C | T | 0.00% | 0.01% | 99.97% | 0.01% | 0.00% | 99.96% | 0.00% | 99.95% | 0.01% |
| nogRNA-N1387spilt-KKH-Cas9-N1387-N and dSpCas9-N1387-C | C | 0.00% | 99.97% | 0.01% | 0.00% | 99.98% | 0.00% | 99.98% | 0.02% | 0.01% |
| nogRNA-N1387spilt-KKH-Cas9-N1387-N and dSpCas9-N1387-C | G | 99.98% | 0.00% | 0.00% | 99.97% | 0.00% | 0.00% | 0.00% | 0.00% | 99.95% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.01% | 0.01% | 0.01% | 0.01% | 0.01% | 0.01% | 0.01% |
| nogRNA-N1387spilt-KKH-Cas9-N1387-C and dSpCas9-N1387-N | A | 0.00% | 0.00% | 0.00% | 0.03% | 0.00% | 0.01% | 0.01% | 0.00% | 0.00% |
| nogRNA-N1387spilt-KKH-Cas9-N1387-C and dSpCas9-N1387-N | T | 0.00% | 0.00% | 99.94% | 0.00% | 0.00% | 99.97% | 0.01% | 99.98% | 0.01% |
| nogRNA-N1387spilt-KKH-Cas9-N1387-C and dSpCas9-N1387-N | C | 0.00% | 99.99% | 0.04% | 0.00% | 99.99% | 0.01% | 99.97% | 0.01% | 0.00% |
| nogRNA-N1387spilt-KKH-Cas9-N1387-C and dSpCas9-N1387-N | G | 99.98% | 0.00% | 0.00% | 99.96% | 0.00% | 0.00% | 0.00% | 0.00% | 99.97% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.01% | 0.01% | 0.01% | 0.01% | 0.01% | 0.01% | 0.01% |

| Batch | Nucleotide | G | G | G | G | C | C | T | C |
|---|---|---|---|---|---|---|---|---|---|
| nogRNA-A1343spilt-KKH-Cas9-A1343-N and dSpCas9-A1343-C | A | 0.01% | 0.00% | 0.02% | 0.00% | 0.00% | 0.02% | 0.00% | 0.00% |
| nogRNA-A1343spilt-KKH-Cas9-A1343-N and dSpCas9-A1343-C | T | 0.01% | 0.02% | 0.01% | 0.01% | 0.01% | 0.02% | 99.98% | 0.02% |
| nogRNA-A1343spilt-KKH-Cas9-A1343-N and dSpCas9-A1343-C | C | 0.00% | 0.00% | 0.01% | 0.00% | 99.99% | 99.95% | 0.02% | 99.98% |
| nogRNA-A1343spilt-KKH-Cas9-A1343-N and dSpCas9-A1343-C | G | 99.98% | 99.97% | 99.95% | 99.94% | 0.00% | 0.00% | 0.00% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.01% | 0.04% | 0.00% | 0.00% | 0.00% | 0.00% |
| nogRNA-A1343spilt-KKH-Cas9-A1343-C and dSpCas9-A1343-N | A | 0.00% | 0.01% | 0.02% | 0.00% | 0.00% | 0.04% | 0.00% | 0.00% |
| nogRNA-A1343spilt-KKH-Cas9-A1343-C and dSpCas9-A1343-N | T | 0.01% | 0.00% | 0.00% | 0.00% | 0.01% | 0.00% | 99.99% | 0.00% |

TABLE 10C-continued

| No gRNA | | | | | | | | | |
|---|---|---|---|---|---|---|---|---|---|
| nogRNA-A1343spilt-KKH-Cas9-A1343-C and dSpCas9-A1343-N | C | 0.00% | 0.00% | 0.00% | 0.00% | 99.99% | 99.95% | 0.01% | 100.00% |
| nogRNA-A1343spilt-KKH-Cas9-A1343-C and dSpCas9-A1343-N | G | 99.98% | 99.98% | 99.98% | 99.93% | 0.00% | 0.00% | 0.00% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.06% | 0.00% | 0.00% | 0.00% | 0.00% |
| nogRNA-G1322spilt-KKH-Cas9-G1322-N and dSpCas9-G1322-C | A | 0.01% | 0.00% | 0.00% | 0.02% | 0.00% | 0.00% | 0.00% | 0.00% |
| nogRNA-G1322spilt-KKH-Cas9-G1322-N and dSpCas9-G1322-C | T | 0.01% | 0.01% | 0.01% | 0.00% | 0.00% | 0.00% | 99.98% | 0.02% |
| nogRNA-G1322spilt-KKH-Cas9-G1322-N and dSpCas9-G1322-C | C | 0.00% | 0.00% | 0.00% | 0.00% | 10.000% | 99.99% | 0.01% | 99.98% |
| nogRNA-G1322spilt-KKH-Cas9-G1322-N and dSpCas9-G1322-C | G | 99.98% | 99.99% | 99.98% | 99.93% | 0.00% | 0.00% | 0.01% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.04% | 0.00% | 0.00% | 0.00% | 0.00% |
| nogRNA-G1322spilt-KKH-Cas9-G1322-C and dSpCas9-G1322-N | A | 0.02% | 0.02% | 0.02% | 0.02% | 0.00% | 0.01% | 0.00% | 0.00% |
| nogRNA-G1322spilt-KKH-Cas9-G1322-C and dSpCas9-G1322-N | T | 0.03% | 0.02% | 0.01% | 0.00% | 0.00% | 0.02% | 99.96% | 0.02% |
| nogRNA-G1322spilt-KKH-Cas9-G1322-C and dSpCas9-G1322-N | C | 0.00% | 0.00% | 0.00% | 0.00% | 99.99% | 99.97% | 0.03% | 99.98% |
| nogRNA-G1322spilt-KKH-Cas9-G1322-C and dSpCas9-G1322-N | G | 99.95% | 99.97% | 99.97% | 99.94% | 0.01% | 0.00% | 0.01% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.04% | 0.00% | 0.00% | 0.00% | 0.00% |
| nogRNA-G1333spilt-KKH-Cas9-G1333-N and dSpCas9-G1333-C | A | 0.02% | 0.01% | 0.02% | 0.01% | 0.01% | 0.02% | 0.00% | 0.00% |
| nogRNA-G1333spilt-KKH-Cas9-G1333-N and dSpCas9-G1333-C | T | 0.00% | 0.00% | 0.01% | 0.00% | 0.01% | 0.01% | 99.97% | 0.01% |
| nogRNA-G1333spilt-KKH-Cas9-G1333-N and dSpCas9-G1333-C | C | 0.00% | 0.00% | 0.00% | 0.00% | 99.97% | 99.97% | 0.03% | 99.98% |
| nogRNA-G1333spilt-KKH-Cas9-G1333-N and dSpCas9-G1333-C | G | 99.97% | 99.99% | 99.97% | 99.94% | 0.00% | 0.00% | 0.00% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.05% | 0.00% | 0.00% | 0.00% | 0.00% |
| nogRNA-G1333spilt-KKH-Cas9-G1333-C and dSpCas9-G1333-N | A | 0.01% | 0.00% | 0.00% | 0.00% | 0.00% | 0.00% | 0.00% | 0.00% |
| nogRNA-G1333spilt-KKH-Cas9-G1333-C and dSpCas9-G1333-N | T | 0.03% | 0.03% | 0.02% | 0.01% | 0.00% | 0.01% | 99.99% | 0.05% |
| nogRNA-G1333spilt-KKH-Cas9-G1333-C and dSpCas9-G1333-N | C | 0.00% | 0.00% | 0.00% | 0.00% | 99.99% | 99.99% | 0.00% | 99.94% |
| nogRNA-G1333spilt-KKH-Cas9-G1333-C and dSpCas9-G1333-N | G | 99.96% | 99.96% | 99.97% | 99.95% | 0.00% | 0.00% | 0.00% | 0.00% |

TABLE 10C-continued

| No gRNA | | | | | | | | | |
|---|---|---|---|---|---|---|---|---|---|
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.04% | 0.00% | 0.00% | 0.00% | 0.00% |
| nogRNA-G1371spilt-KKH-Cas9-G1371-N and dSpCas9-G1371-C | A | 0.01% | 0.00% | 0.00% | 0.02% | 0.00% | 0.01% | 0.01% | 0.00% |
| nogRNA-G1371spilt-KKH-Cas9-G1371-N and dSpCas9-G1371-C | T | 0.02% | 0.01% | 0.01% | 0.02% | 0.00% | 0.00% | 99.98% | 0.00% |
| nogRNA-G1371spilt-KKH-Cas9-G1371-N and dSpCas9-G1371-C | C | 0.00% | 0.00% | 0.00% | 0.00% | 100.00% | 99.98% | 0.01% | 100.00% |
| nogRNA-G1371spilt-KKH-Cas9-G1371-N and dSpCas9-G1371-C | G | 99.97% | 99.98% | 99.98% | 99.93% | 0.00% | 0.00% | 0.00% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.04% | 0.00% | 0.00% | 0.00% | 0.00% |
| nogRNA-G1371spilt-KKH-Cas9-G1371-C and dSpCas9-G1371-N | A | 0.02% | 0.02% | 0.01% | 0.00% | 0.00% | 0.01% | 0.00% | 0.01% |
| nogRNA-G1371spilt-KKH-Cas9-G1371-C and dSpCas9-G1371-N | T | 0.00% | 0.01% | 0.01% | 0.01% | 0.01% | 0.01% | 99.95% | 0.02% |
| nogRNA-G1371spilt-KKH-Cas9-G1371-C and dSpCas9-G1371-N | C | 0.00% | 0.00% | 0.00% | 0.00% | 99.97% | 99.96% | 0.01% | 99.95% |
| nogRNA-G1371spilt-KKH-Cas9-G1371-C and dSpCas9-G1371-N | G | 99.96% | 99.94% | 99.96% | 99.94% | 0.00% | 0.00% | 0.01% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.02% | 0.02% | 0.02% | 0.05% | 0.02% | 0.02% | 0.02% | 0.02% |
| nogRNA-G1397spilt-KKH-Cas9-G1397-N and dSpCas9-G1397-C | A | 0.03% | 0.01% | 0.00% | 0.00% | 0.00% | 0.00% | 0.02% | 0.00% |
| nogRNA-G1397spilt-KKH-Cas9-G1397-N and dSpCas9-G1397-C | T | 0.02% | 0.03% | 0.01% | 0.01% | 0.01% | 0.01% | 99.64% | 0.00% |
| nogRNA-G1397spilt-KKH-Cas9-G1397-N and dSpCas9-G1397-C | C | 0.00% | 0.00% | 0.00% | 0.00% | 99.66% | 99.66% | 0.01% | 99.67% |
| nogRNA-G1397spilt-KKH-Cas9-G1397-N and dSpCas9-G1397-C | G | 99.67% | 99.67% | 99.66% | 99.61% | 0.00% | 0.00% | 0.00% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.28% | 0.29% | 0.32% | 0.37% | 0.32% | 0.32% | 0.33% | 0.33% |
| nogRNA-G1397spilt-KKH-Cas9-G1397-C and dSpCas9-G1397-N | A | 0.01% | 0.02% | 0.01% | 0.02% | 0.01% | 0.01% | 0.01% | 0.00% |
| nogRNA-G1397spilt-KKH-Cas9-G1397-C and dSpCas9-G1397-N | T | 0.01% | 0.01% | 0.00% | 0.01% | 0.00% | 0.01% | 99.94% | 0.02% |
| nogRNA-G1397spilt-KKH-Cas9-G1397-C and dSpCas9-G1397-N | C | 0.00% | 0.00% | 0.00% | 0.00% | 99.97% | 99.96% | 0.02% | 99.96% |
| nogRNA-G1397spilt-KKH-Cas9-G1397-C and dSpCas9-G1397-N | G | 99.96% | 99.94% | 99.96% | 99.93% | 0.00% | 0.00% | 0.00% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.02% | 0.02% | 0.02% | 0.04% | 0.02% | 0.02% | 0.01% | 0.01% |

TABLE 10C-continued

| | | No gRNA | | | | | | | |
|---|---|---|---|---|---|---|---|---|---|
| nogRNA-N1357spilt-KKH-Cas9-N1357-N and dSpCas9-N1357-C | A | 0.02% | 0.00% | 0.01% | 0.00% | 0.00% | 0.00% | 0.00% | 0.01% |
| nogRNA-N1357spilt-KKH-Cas9-N1357-N and dSpCas9-N1357-C | T | 0.02% | 0.00% | 0.02% | 0.00% | 0.02% | 0.02% | 99.99% | 0.01% |
| nogRNA-N1357spilt-KKH-Cas9-N1357-N and dSpCas9-N1357-C | C | 0.00% | 0.00% | 0.00% | 0.00% | 99.98% | 99.98% | 0.01% | 99.98% |
| nogRNA-N1357spilt-KKH-Cas9-N1357-N and dSpCas9-N1357-C | G | 99.96% | 99.99% | 99.97% | 99.93% | 0.00% | 0.00% | 0.00% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.06% | 0.00% | 0.00% | 0.00% | 0.00% |
| nogRNA-N1357spilt-KKH-Cas9-N1357-C and dSpCas9-N1357-N | A | 0.00% | 0.01% | 0.01% | 0.02% | 0.02% | 0.00% | 0.01% | 0.00% |
| nogRNA-N1357spilt-KKH-Cas9-N1357-C and dSpCas9-N1357-N | T | 0.01% | 0.02% | 0.00% | 0.01% | 0.03% | 0.03% | 99.97% | 0.00% |
| nogRNA-N1357spilt-KKH-Cas9-N1357-C and dSpCas9-N1357-N | C | 0.01% | 0.01% | 0.00% | 0.00% | 99.95% | 99.97% | 0.02% | 100.00% |
| nogRNA-N1357spilt-KKH-Cas9-N1357-C and dSpCas9-N1357-N | G | 99.99% | 99.97% | 99.99% | 99.93% | 0.01% | 0.00% | 0.00% | 0.00% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.05% | 0.00% | 0.00% | 0.00% | 0.00% |
| nogRNA-N1387spilt-KKH-Cas9-N1387-N and dSpCas9-N1387-C | A | 0.01% | 0.01% | 0.02% | 0.02% | 0.00% | 0.01% | 0.00% | 0.00% |
| nogRNA-N1387spilt-KKH-Cas9-N1387-N and dSpCas9-N1387-C | T | 0.02% | 0.01% | 0.01% | 0.01% | 0.01% | 0.00% | 99.98% | 0.02% |
| nogRNA-N1387spilt-KKH-Cas9-N1387-N and dSpCas9-N1387-C | C | 0.01% | 0.00% | 0.00% | 0.00% | 99.98% | 99.97% | 0.00% | 99.97% |
| nogRNA-N1387spilt-KKH-Cas9-N1387-N and dSpCas9-N1387-C | G | 99.95% | 99.96% | 99.96% | 99.94% | 0.00% | 0.00% | 0.01% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.01% | 0.03% | 0.01% | 0.01% | 0.01% | 0.01% |
| nogRNA-N1387spilt-KKH-Cas9-N1387-C and dSpCas9-N1387-N | A | 0.01% | 0.02% | 0.01% | 0.01% | 0.01% | 0.01% | 0.00% | 0.00% |
| nogRNA-N1387spilt-KKH-Cas9-N1387-C and dSpCas9-N1387-N | T | 0.04% | 0.02% | 0.00% | 0.01% | 0.01% | 0.00% | 99.96% | 0.01% |
| nogRNA-N1387spilt-KKH-Cas9-N1387-C and dSpCas9-N1387-N | C | 0.00% | 0.01% | 0.00% | 0.00% | 99.97% | 99.98% | 0.02% | 99.98% |
| nogRNA-N1387spilt-KKH-Cas9-N1387-C and dSpCas9-N1387-N | G | 99.94% | 99.93% | 99.97% | 99.93% | 0.00% | 0.00% | 0.00% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.01% | 0.05% | 0.01% | 0.01% | 0.01% | 0.01% |

| Batch | Nucleotide | C | T | G | A | G | T | T |
|---|---|---|---|---|---|---|---|---|
| nogRNA-A1343spilt-KKH-Cas9-A1343-N and dSpCas9-A1343-C | A | 0.00% | 0.01% | 0.02% | 99.94% | 0.00% | 0.00% | 0.00% |

TABLE 10C-continued

| No gRNA | | | | | | | | |
|---|---|---|---|---|---|---|---|---|
| nogRNA-A1343spilt-KKH-Cas9-A1343-N and dSpCas9-A1343-C | T | 0.02% | 99.98% | 0.01% | 0.01% | 0.01% | 99.98% | 99.99% |
| nogRNA-A1343spilt-KKH-Cas9-A1343-N and dSpCas9-A1343-C | C | 99.98% | 0.01% | 0.00% | 0.03% | 0.00% | 0.02% | 0.01% |
| nogRNA-A1343spilt-KKH-Cas9-A1343-N and dSpCas9-A1343-C | G | 0.00% | 0.00% | 99.97% | 0.02% | 99.99% | 0.01% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.01% | 0.00% | 0.02% | 99.91% | 0.00% | 0.00% | 0.00% |
| nogRNA-A1343spilt-KKH-Cas9-A1343-C and dSpCas9-A1343-N | T | 0.01% | 99.96% | 0.02% | 0.00% | 0.00% | 100.00% | 100.00% |
| nogRNA-A1343spilt-KKH-Cas9-A1343-C and dSpCas9-A1343-N | C | 99.98% | 0.03% | 0.00% | 0.05% | 0.00% | 0.00% | 0.00% |
| nogRNA-A1343spilt-KKH-Cas9-A1343-C and dSpCas9-A1343-N | G | 0.00% | 0.00% | 99.96% | 0.04% | 100.00% | 0.00% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.01% | 0.00% | 0.02% | 99.95% | 0.01% | 0.00% | 0.00% |
| nogRNA-G1322spilt-KKH-Cas9-G1322-N and dSpCas9-G1322-C | T | 0.01% | 99.97% | 0.01% | 0.01% | 0.00% | 99.98% | 99.97% |
| nogRNA-G1322spilt-KKH-Cas9-G1322-N and dSpCas9-G1322-C | C | 99.98% | 0.03% | 0.00% | 0.02% | 0.00% | 0.01% | 0.02% |
| nogRNA-G1322spilt-KKH-Cas9-G1322-N and dSpCas9-G1322-C | G | 0.00% | 0.00% | 99.97% | 0.03% | 99.99% | 0.01% | 0.01% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.01% | 0.00% | 0.02% | 99.93% | 0.00% | 0.00% | 0.00% |
| nogRNA-G1322spilt-KKH-Cas9-G1322-C and dSpCas9-G1322-N | T | 0.00% | 99.97% | 0.02% | 0.00% | 0.00% | 99.96% | 99.99% |
| nogRNA-G1322spilt-KKH-Cas9-G1322-C and dSpCas9-G1322-N | C | 99.99% | 0.02% | 0.00% | 0.03% | 0.00% | 0.01% | 0.00% |
| nogRNA-G1322spilt-KKH-Cas9-G1322-C and dSpCas9-G1322-N | G | 0.00% | 0.00% | 99.96% | 0.04% | 100.00% | 0.03% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 0.01% | 0.01% | 99.96% | 0.00% | 0.01% | 0.00% |
| nogRNA-G1333spilt-KKH-Cas9-G1333-N and dSpCas9-G1333-C | T | 0.00% | 99.94% | 0.00% | 0.01% | 0.00% | 99.96% | 99.98% |
| nogRNA-G1333spilt-KKH-Cas9-G1333-N and dSpCas9-G1333-C | C | 99.98% | 0.04% | 0.00% | 0.01% | 0.00% | 0.02% | 0.01% |

TABLE 10C-continued

| No gRNA | | | | | | | | |
|---|---|---|---|---|---|---|---|---|
| nogRNA-G1333spilt-KKH-Cas9-G1333-N and dSpCas9-G1333-C | G | 0.00% | 0.00% | 99.98% | 0.01% | 100.00% | 0.01% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.01% | 0.00% | 99.90% | 0.00% | 0.00% | 0.00% |
| nogRNA-G1333spilt-KKH-Cas9-G1333-C and dSpCas9-G1333-N | T | 0.01% | 99.98% | 0.01% | 0.00% | 0.00% | 99.99% | 99.98% |
| nogRNA-G1333spilt-KKH-Cas9-G1333-C and dSpCas9-G1333-N | C | 99.99% | 0.01% | 0.00% | 0.05% | 0.00% | 0.01% | 0.02% |
| nogRNA-G1333spilt-KKH-Cas9-G1333-C and dSpCas9-G1333-N | G | 0.00% | 0.00% | 99.98% | 0.05% | 100.00% | 0.00% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.01% | 0.00% | 0.02% | 99.89% | 0.01% | 0.00% | 0.00% |
| nogRNA-G1371spilt-KKH-Cas9-G1371-N and dSpCas9-G1371-C | T | 0.00% | 99.98% | 0.01% | 0.01% | 0.00% | 99.98% | 99.99% |
| nogRNA-G1371spilt-KKH-Cas9-G1371-N and dSpCas9-G1371-C | C | 99.98% | 0.01% | 0.00% | 0.06% | 0.00% | 0.01% | 0.00% |
| nogRNA-G1371spilt-KKH-Cas9-G1371-N and dSpCas9-G1371-C | G | 0.00% | 0.00% | 99.97% | 0.04% | 99.99% | 0.01% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.01% | 0.00% | 0.00% | 0.00% | 0.00% | 0.00% | 0.00% |
| nogRNA-G1371spilt-KKH-Cas9-G1371-C and dSpCas9-G1371-N | A | 0.00% | 0.00% | 0.01% | 99.92% | 0.00% | 0.00% | 0.00% |
| nogRNA-G1371spilt-KKH-Cas9-G1371-C and dSpCas9-G1371-N | T | 0.01% | 99.96% | 0.01% | 0.01% | 0.00% | 99.94% | 99.95% |
| nogRNA-G1371spilt-KKH-Cas9-G1371-C and dSpCas9-G1371-N | C | 99.97% | 0.00% | 0.00% | 0.03% | 0.00% | 0.02% | 0.01% |
| nogRNA-G1371spilt-KKH-Cas9-G1371-C and dSpCas9-G1371-N | G | 0.00% | 0.01% | 99.96% | 0.02% | 99.97% | 0.00% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.02% | 0.02% | 0.02% | 0.03% | 0.03% | 0.03% | 0.03% |
| nogRNA-G1397spilt-KKH-Cas9-G1397-N and dSpCas9-G1397-C | A | 0.00% | 0.00% | 0.01% | 99.60% | 0.00% | 0.00% | 0.00% |
| nogRNA-G1397spilt-KKH-Cas9-G1397-N and dSpCas9-G1397-C | T | 0.01% | 99.64% | 0.01% | 0.00% | 0.00% | 99.66% | 99.65% |
| nogRNA-G1397spilt-KKH-Cas9-G1397-N and dSpCas9-G1397-C | C | 99.66% | 0.02% | 0.00% | 0.03% | 0.00% | 0.00% | 0.02% |
| nogRNA-G1397spilt-KKH-Cas9-G1397-N and dSpCas9-G1397-C | G | 0.00% | 0.01% | 99.64% | 0.03% | 99.66% | 0.01% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% |

TABLE 10C-continued

| No gRNA | | | | | | | | |
|---|---|---|---|---|---|---|---|---|
| nogRNA-G1397spilt-KKH-Cas9-G1397-N and dSpCas9-G1397-C | — | 0.33% | 0.33% | 0.33% | 0.34% | 0.34% | 0.33% | 0.33% |
| nogRNA-G1397spilt-KKH-Cas9-G1397-C and dSpCas9-G1397-N | A | 0.01% | 0.00% | 0.00% | 99.93% | 0.00% | 0.00% | 0.00% |
| nogRNA-G1397spilt-KKH-Cas9-G1397-C and dSpCas9-G1397-N | T | 0.01% | 99.98% | 0.01% | 0.00% | 0.00% | 99.95% | 99.99% |
| nogRNA-G1397spilt-KKH-Cas9-G1397-C and dSpCas9-G1397-N | C | 99.97% | 0.00% | 0.00% | 0.03% | 0.00% | 0.02% | 0.00% |
| nogRNA-G1397spilt-KKH-Cas9-G1397-C and dSpCas9-G1397-N | G | 0.00% | 0.00% | 99.98% | 0.02% | 99.99% | 0.02% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.01% | 0.01% | 0.01% | 0.01% | 0.01% | 0.01% | 0.01% |
| nogRNA-N1357spilt-KKH-Cas9-N1357-N and dSpCas9-N1357-C | A | 0.00% | 0.01% | 0.02% | 99.95% | 0.01% | 0.00% | 0.00% |
| nogRNA-N1357spilt-KKH-Cas9-N1357-N and dSpCas9-N1357-C | T | 0.01% | 99.97% | 0.01% | 0.01% | 0.00% | 99.98% | 100.00% |
| nogRNA-N1357spilt-KKH-Cas9-N1357-N and dSpCas9-N1357-C | C | 99.99% | 0.02% | 0.00% | 0.02% | 0.00% | 0.00% | 0.00% |
| nogRNA-N1357spilt-KKH-Cas9-N1357-N and dSpCas9-N1357-C | G | 0.00% | 0.00% | 99.98% | 0.03% | 99.99% | 0.02% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.00% | 0.00% | 0.01% | 99.88% | 0.00% | 0.01% | 0.00% |
| nogRNA-N1357spilt-KKH-Cas9-N1357-C and dSpCas9-N1357-N | T | 0.01% | 99.98% | 0.02% | 0.01% | 0.01% | 99.97% | 99.99% |
| nogRNA-N1357spilt-KKH-Cas9-N1357-C and dSpCas9-N1357-N | C | 99.99% | 0.02% | 0.00% | 0.08% | 0.00% | 0.00% | 0.01% |
| nogRNA-N1357spilt-KKH-Cas9-N1357-C and dSpCas9-N1357-N | G | 0.00% | 0.01% | 99.97% | 0.03% | 99.99% | 0.02% | 0.00% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.00% | 0.01% | 0.02% | 99.89% | 0.01% | 0.00% | 0.00% |
| nogRNA-N1387spilt-KKH-Cas9-N1387-N and dSpCas9-N1387-C | T | 0.01% | 99.96% | 0.01% | 0.01% | 0.00% | 99.97% | 99.97% |
| nogRNA-N1387spilt-KKH-Cas9-N1387-N and dSpCas9-N1387-C | C | 99.97% | 0.02% | 0.00% | 0.04% | 0.00% | 0.01% | 0.01% |
| nogRNA-N1387spilt-KKH-Cas9-N1387-N and dSpCas9-N1387-C | G | 0.00% | 0.01% | 99.96% | 0.05% | 99.98% | 0.00% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.01% | 0.01% | 0.01% | 0.01% | 0.02% |
| nogRNA-N1387spilt-KKH-Cas9-N1387-C and dSpCas9-N1387-N | A | 0.00% | 0.00% | 0.01% | 99.92% | 0.01% | 0.00% | 0.00% |

TABLE 10C-continued

| | | No gRNA | | | | | | |
|---|---|---|---|---|---|---|---|---|
| nogRNA-N1387spilt-KKH-Cas9-N1387-C and dSpCas9-N1387-N | T | 0.01% | 99.95% | 0.00% | 0.00% | 0.00% | 99.96% | 99.97% |
| nogRNA-N1387spilt-KKH-Cas9-N1387-C and dSpCas9-N1387-N | C | 99.97% | 0.03% | 0.00% | 0.02% | 0.00% | 0.01% | 0.02% |
| nogRNA-N1387spilt-KKH-Cas9-N1387-C and dSpCas9-N1387-N | G | 0.00% | 0.00% | 99.98% | 0.04% | 99.97% | 0.00% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.01% | 0.01% | 0.01% | 0.01% | 0.01% |

| Batch | Nucleotide | T | C | T | C | A | T | C | T | G |
|---|---|---|---|---|---|---|---|---|---|---|
| nogRNA-A1343spilt-KKH-Cas9-A1343-N and dSpCas9-A1343-C | A | 0.00% | 0.00% | 0.01% | 0.01% | 99.95% | 0.00% | 0.00% | 0.00% | 0.01% |
| nogRNA-A1343spilt-KKH-Cas9-A1343-N and dSpCas9-A1343-C | T | 99.99% | 0.01% | 99.97% | 0.01% | 0.01% | 99.98% | 0.01% | 99.99% | 0.00% |
| nogRNA-A1343spilt-KKH-Cas9-A1343-N and dSpCas9-A1343-C | C | 0.01% | 99.98% | 0.01% | 99.98% | 0.00% | 0.01% | 99.99% | 0.01% | 0.00% |
| nogRNA-A1343spilt-KKH-Cas9-A1343-N and dSpCas9-A1343-C | G | 0.00% | 0.00% | 0.01% | 0.00% | 0.04% | 0.00% | 0.00% | 0.00% | 99.99% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 0.00% | 0.01% | 0.01% | 99.95% | 0.00% | 0.01% | 0.01% | 0.02% |
| nogRNA-A1343spilt-KKH-Cas9-A1343-C and dSpCas9-A1343-N | T | 100.00% | 0.01% | 99.97% | 0.03% | 0.00% | 100.00% | 0.00% | 99.97% | 0.01% |
| nogRNA-A1343spilt-KKH-Cas9-A1343-C and dSpCas9-A1343-N | C | 0.00% | 99.99% | 0.01% | 99.96% | 0.04% | 0.00% | 99.97% | 0.02% | 0.00% |
| nogRNA-A1343spilt-KKH-Cas9-A1343-C and dSpCas9-A1343-N | G | 0.00% | 0.00% | 0.00% | 0.00% | 0.01% | 0.00% | 0.01% | 0.00% | 99.97% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 0.00% | 0.01% | 0.01% | 99.96% | 0.00% | 0.00% | 0.01% | 0.00% |
| nogRNA-G1322spilt-KKH-Cas9-G1322-N and dSpCas9-G1322-C | T | 99.99% | 0.00% | 99.97% | 0.01% | 0.00% | 99.99% | 0.00% | 99.96% | 0.02% |
| nogRNA-G1322spilt-KKH-Cas9-G1322-N and dSpCas9-G1322-C | C | 0.01% | 99.99% | 0.02% | 99.97% | 0.01% | 0.01% | 99.99% | 0.02% | 0.00% |
| nogRNA-G1322spilt-KKH-Cas9-G1322-N and dSpCas9-G1322-C | G | 0.00% | 0.00% | 0.00% | 0.00% | 0.03% | 0.00% | 0.00% | 0.00% | 99.98% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 0.00% | 0.01% | 0.00% | 99.96% | 0.00% | 0.01% | 0.00% | 0.00% |
| nogRNA-G1322spilt-KKH-Cas9-G1322-C and dSpCas9-G1322-N | T | 99.97% | 0.00% | 99.98% | 0.01% | 0.00% | 99.98% | 0.01% | 99.97% | 0.01% |

TABLE 10C-continued

| No gRNA | | | | | | | | | | |
|---|---|---|---|---|---|---|---|---|---|---|
| nogRNA-G1322spilt-KKH-Cas9-G1322-C and dSpCas9-G1322-N | C | 0.02% | 100.00% | 0.00% | 99.98% | 0.00% | 0.01% | 99.97% | 0.01% | 0.00% |
| nogRNA-G1322spilt-KKH-Cas9-G1322-C and dSpCas9-G1322-N | G | 0.00% | 0.00% | 0.00% | 0.00% | 0.03% | 0.00% | 0.00% | 0.01% | 99.97% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.01% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 0.00% | 0.00% | 0.01% | 99.95% | 0.00% | 0.00% | 0.01% | 0.01% |
| nogRNA-G1333spilt-KKH-Cas9-G1333-N and dSpCas9-G1333-C | T | 99.97% | 0.01% | 99.96% | 0.01% | 0.00% | 99.99% | 0.02% | 99.97% | 0.01% |
| nogRNA-G1333spilt-KKH-Cas9-G1333-N and dSpCas9-G1333-C | C | 0.01% | 99.98% | 0.03% | 99.97% | 0.00% | 0.00% | 99.97% | 0.02% | 0.00% |
| nogRNA-G1333spilt-KKH-Cas9-G1333-N and dSpCas9-G1333-C | G | 0.01% | 0.00% | 0.01% | 0.00% | 0.04% | 0.00% | 0.00% | 0.00% | 99.97% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.00% | 0.02% | 0.00% | 99.98% | 0.00% | 0.00% | 0.02% | 0.01% |
| nogRNA-G1333spilt-KKH-Cas9-G1333-C and dSpCas9-G1333-N | T | 99.97% | 0.01% | 99.97% | 0.03% | 0.00% | 99.98% | 0.01% | 99.96% | 0.01% |
| nogRNA-G1333spilt-KKH-Cas9-G1333-C and dSpCas9-G1333-N | C | 0.02% | 99.99% | 0.01% | 99.97% | 0.00% | 0.01% | 99.99% | 0.02% | 0.00% |
| nogRNA-G1333spilt-KKH-Cas9-G1333-C and dSpCas9-G1333-N | G | 0.01% | 0.00% | 0.00% | 0.00% | 0.02% | 0.00% | 0.00% | 0.00% | 99.98% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.00% | 0.00% | 0.02% | 0.01% | 99.94% | 0.00% | 0.02% | 0.01% | 0.01% |
| nogRNA-G1371spilt-KKH-Cas9-G1371-N and dSpCas9-G1371-C | T | 99.98% | 0.01% | 99.97% | 0.03% | 0.01% | 99.98% | 0.01% | 99.98% | 0.02% |
| nogRNA-G1371spilt-KKH-Cas9-G1371-N and dSpCas9-G1371-C | C | 0.02% | 99.98% | 0.02% | 99.96% | 0.00% | 0.01% | 99.97% | 0.01% | 0.00% |
| nogRNA-G1371spilt-KKH-Cas9-G1371-N and dSpCas9-G1371-C | G | 0.00% | 0.00% | 0.00% | 0.00% | 0.05% | 0.00% | 0.00% | 0.00% | 99.97% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.00% | 0.00% | 0.01% | 0.00% | 99.94% | 0.00% | 0.00% | 0.00% | 0.02% |
| nogRNA-G1371spilt-KKH-Cas9-G1371-C and dSpCas9-G1371-N | T | 99.96% | 0.01% | 99.94% | 0.02% | 0.00% | 99.95% | 0.00% | 99.95% | 0.01% |
| nogRNA-G1371spilt-KKH-Cas9-G1371-C and dSpCas9-G1371-N | C | 0.00% | 99.96% | 0.02% | 99.94% | 0.01% | 0.01% | 99.96% | 0.01% | 0.00% |
| nogRNA-G1371spilt-KKH-Cas9-G1371-C and dSpCas9-G1371-N | G | 0.01% | 0.00% | 0.00% | 0.00% | 0.01% | 0.00% | 0.00% | 0.00% | 99.93% |

TABLE 10C-continued

| No gRNA | | | | | | | | | | |
|---|---|---|---|---|---|---|---|---|---|---|
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.03% | 0.03% | 0.03% | 0.03% | 0.04% | 0.04% | 0.04% | 0.03% | 0.03% |
| nogRNA-G1397spilt-KKH-Cas9-G1397-N and dSpCas9-G1397-C | A | 0.00% | 0.01% | 0.02% | 0.00% | 99.64% | 0.00% | 0.01% | 0.01% | 0.01% |
| nogRNA-G1397spilt-KKH-Cas9-G1397-N and dSpCas9-G1397-C | T | 99.66% | 0.01% | 99.63% | 0.00% | 0.01% | 99.65% | 0.01% | 99.65% | 0.00% |
| nogRNA-G1397spilt-KKH-Cas9-G1397-N and dSpCas9-G1397-C | C | 0.01% | 99.65% | 0.00% | 99.66% | 0.00% | 0.00% | 99.65% | 0.00% | 0.00% |
| nogRNA-G1397spilt-KKH-Cas9-G1397-N and dSpCas9-G1397-C | G | 0.00% | 0.00% | 0.01% | 0.00% | 0.02% | 0.01% | 0.00% | 0.00% | 99.65% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.33% | 0.33% | 0.34% | 0.34% | 0.33% | 0.33% | 0.33% | 0.33% | 0.33% |
| nogRNA-G1397spilt-KKH-Cas9-G1397-C and dSpCas9-G1397-N | A | 0.00% | 0.00% | 0.01% | 0.00% | 99.94% | 0.00% | 0.01% | 0.00% | 0.02% |
| nogRNA-G1397spilt-KKH-Cas9-G1397-C and dSpCas9-G1397-N | T | 99.99% | 0.01% | 99.96% | 0.01% | 0.00% | 99.97% | 0.01% | 99.97% | 0.01% |
| nogRNA-G1397spilt-KKH-Cas9-G1397-C and dSpCas9-G1397-N | C | 0.00% | 99.98% | 0.01% | 99.98% | 0.01% | 0.01% | 99.97% | 0.01% | 0.00% |
| nogRNA-G1397spilt-KKH-Cas9-G1397-C and dSpCas9-G1397-N | G | 0.00% | 0.00% | 0.00% | 0.00% | 0.04% | 0.00% | 0.00% | 0.00% | 99.95% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.01% | 0.01% | 0.01% | 0.01% | 0.01% | 0.01% | 0.01% | 0.02% | 0.02% |
| nogRNA-N1357spilt-KKH-Cas9-N1357-N and dSpCas9-N1357-C | A | 0.00% | 0.00% | 0.01% | 0.00% | 99.97% | 0.00% | 0.00% | 0.00% | 0.02% |
| nogRNA-N1357spilt-KKH-Cas9-N1357-N and dSpCas9-N1357-C | T | 99.98% | 0.02% | 99.97% | 0.02% | 0.01% | 99.99% | 0.01% | 99.98% | 0.02% |
| nogRNA-N1357spilt-KKH-Cas9-N1357-N and dSpCas9-N1357-C | C | 0.01% | 99.98% | 0.00% | 99.98% | 0.01% | 0.01% | 99.99% | 0.02% | 0.00% |
| nogRNA-N1357spilt-KKH-Cas9-N1357-N and dSpCas9-N1357-C | G | 0.00% | 0.00% | 0.01% | 0.00% | 0.02% | 0.00% | 0.00% | 0.00% | 99.97% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.00% | 0.00% | 0.02% | 0.00% | 99.93% | 0.01% | 0.01% | 0.01% | 0.02% |
| nogRNA-N1357spilt-KKH-Cas9-N1357-C and dSpCas9-N1357-N | T | 99.99% | 0.01% | 99.97% | 0.02% | 0.00% | 99.99% | 0.03% | 99.98% | 0.01% |
| nogRNA-N1357spilt-KKH-Cas9-N1357-C and dSpCas9-N1357-N | C | 0.01% | 99.99% | 0.01% | 99.98% | 0.05% | 0.00% | 99.97% | 0.02% | 0.01% |
| nogRNA-N1357spilt-KKH-Cas9-N1357-C and dSpCas9-N1357-N | G | 0.00% | 0.00% | 0.01% | 0.00% | 0.02% | 0.00% | 0.00% | 0.00% | 99.97% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-N1387spilt-KKH-Cas9-N1387-N and dSpCas9-N1387-C | A | 0.00% | 0.00% | 0.03% | 0.01% | 99.96% | 0.00% | 0.01% | 0.01% | 0.00% |
| nogRNA-N1387spilt-KKH-Cas9-N1387-N and dSpCas9-N1387-C | T | 99.97% | 0.00% | 99.94% | 0.04% | 0.00% | 99.96% | 0.04% | 99.96% | 0.01% |
| nogRNA-N1387spilt-KKH-Cas9-N1387-N and dSpCas9-N1387-C | C | 0.00% | 99.97% | 0.01% | 99.94% | 0.00% | 0.01% | 99.94% | 0.00% | 0.00% |
| nogRNA-N1387spilt-KKH-Cas9-N1387-N and dSpCas9-N1387-C | G | 0.00% | 0.00% | 0.00% | 0.00% | 0.01% | 0.01% | 0.00% | 0.00% | 99.97% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.02% | 0.01% | 0.01% | 0.01% | 0.01% | 0.01% | 0.02% | 0.02% | 0.02% |
| nogRNA-N1387spilt-KKH-Cas9-N1387-C and dSpCas9-N1387-N | A | 0.00% | 0.00% | 0.00% | 0.00% | 99.97% | 0.00% | 0.00% | 0.01% | 0.01% |
| nogRNA-N1387spilt-KKH-Cas9-N1387-C and dSpCas9-N1387-N | T | 99.97% | 0.02% | 99.98% | 0.01% | 0.00% | 99.96% | 0.00% | 99.95% | 0.00% |
| nogRNA-N1387spilt-KKH-Cas9-N1387-C and dSpCas9-N1387-N | C | 0.01% | 99.96% | 0.00% | 99.97% | 0.00% | 0.02% | 99.98% | 0.03% | 0.00% |
| nogRNA-N1387spilt-KKH-Cas9-N1387-C and dSpCas9-N1387-N | G | 0.00% | 0.01% | 0.00% | 0.00% | 0.00% | 0.00% | 0.00% | 0.00% | 99.97% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.01% | 0.01% | 0.01% | 0.01% | 0.01% | 0.01% | 0.01% |

| Batch | Nucleotide | T | G | C | C | C | C | T | C |
|---|---|---|---|---|---|---|---|---|---|
| nogRNA-A1343spilt-KKH-Cas9-A1343-N and dSpCas9-A1343-C | A | 0.00% | 0.03% | 0.00% | 0.02% | 0.01% | 0.02% | 0.01% | 0.02% |
| nogRNA-A1343spilt-KKH-Cas9-A1343-N and dSpCas9-A1343-C | T | 99.98% | 0.01% | 0.01% | 0.01% | 0.02% | 0.01% | 99.96% | 0.02% |
| nogRNA-A1343spilt-KKH-Cas9-A1343-N and dSpCas9-A1343-C | C | 0.02% | 0.01% | 99.99% | 99.98% | 99.97% | 99.95% | 0.02% | 99.97% |
| nogRNA-A1343spilt-KKH-Cas9-A1343-N and dSpCas9-A1343-C | G | 0.00% | 99.95% | 0.00% | 0.00% | 0.00% | 0.00% | 0.01% | 0.00% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.01% | 0.00% | 0.00% |
| nogRNA-A1343spilt-KKH-Cas9-A1343-C and dSpCas9-A1343-N | A | 0.00% | 0.03% | 0.00% | 0.00% | 0.01% | 0.01% | 0.00% | 0.03% |
| nogRNA-A1343spilt-KKH-Cas9-A1343-C and dSpCas9-A1343-N | T | 99.97% | 0.00% | 0.01% | 0.01% | 0.00% | 0.02% | 99.96% | 0.01% |
| nogRNA-A1343spilt-KKH-Cas9-A1343-C and dSpCas9-A1343-N | C | 0.02% | 0.00% | 99.98% | 99.98% | 99.99% | 99.97% | 0.03% | 99.96% |
| nogRNA-A1343spilt-KKH-Cas9-A1343-C and dSpCas9-A1343-N | G | 0.01% | 99.96% | 0.00% | 0.00% | 0.00% | 0.00% | 0.01% | 0.00% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.02% | 0.02% | 0.00% | 0.01% | 0.02% | 0.02% | 0.02% | 0.00% |

TABLE 10C-continued

| No gRNA | | | | | | | | | |
|---|---|---|---|---|---|---|---|---|---|
| nogRNA-G1322spilt-KKH-Cas9-G1322-N and dSpCas9-G1322-C | T | 99.96% | 0.02% | 0.01% | 0.01% | 0.01% | 0.00% | 99.94% | 0.06% |
| nogRNA-G1322spilt-KKH-Cas9-G1322-N and dSpCas9-G1322-C | C | 0.02% | 0.01% | 99.99% | 99.96% | 99.97% | 99.98% | 0.02% | 99.94% |
| nogRNA-G1322spilt-KKH-Cas9-G1322-N and dSpCas9-G1322-C | G | 0.00% | 99.96% | 0.00% | 0.01% | 0.00% | 0.00% | 0.01% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.01% | 0.01% | 0.00% | 0.01% | 0.02% | 0.01% | 0.01% | 0.01% |
| nogRNA-G1322spilt-KKH-Cas9-G1322-C and dSpCas9-G1322-N | T | 99.95% | 0.00% | 0.04% | 0.02% | 0.03% | 0.03% | 99.97% | 0.02% |
| nogRNA-G1322spilt-KKH-Cas9-G1322-C and dSpCas9-G1322-N | C | 0.01% | 0.00% | 99.95% | 99.96% | 99.95% | 99.93% | 0.01% | 99.96% |
| nogRNA-G1322spilt-KKH-Cas9-G1322-C and dSpCas9-G1322-N | G | 0.02% | 99.98% | 0.01% | 0.01% | 0.00% | 0.00% | 0.00% | 0.00% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.01% | 0.01% | 0.01% | 0.01% | 0.01% | 0.03% | 0.01% | 0.01% |
| nogRNA-G1333spilt-KKH-Cas9-G1333-N and dSpCas9-G1333-C | A | 0.02% | 0.01% | 0.00% | 0.00% | 0.04% | 0.00% | 0.03% | 0.00% |
| nogRNA-G1333spilt-KKH-Cas9-G1333-N and dSpCas9-G1333-C | T | 99.95% | 0.00% | 0.01% | 0.02% | 0.02% | 0.00% | 99.95% | 0.03% |
| nogRNA-G1333spilt-KKH-Cas9-G1333-N and dSpCas9-G1333-C | C | 0.02% | 0.00% | 99.98% | 99.97% | 99.94% | 99.97% | 0.00% | 99.96% |
| nogRNA-G1333spilt-KKH-Cas9-G1333-N and dSpCas9-G1333-C | G | 0.01% | 99.99% | 0.00% | 0.00% | 0.00% | 0.00% | 0.01% | 0.00% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.02% | 0.00% | 0.00% |
| nogRNA-G1333spilt-KKH-Cas9-G1333-C and dSpCas9-G1333-N | A | 0.00% | 0.00% | 0.00% | 0.00% | 0.00% | 0.00% | 0.01% | 0.00% |
| nogRNA-G1333spilt-KKH-Cas9-G1333-C and dSpCas9-G1333-N | T | 99.98% | 0.03% | 0.00% | 0.01% | 0.01% | 0.01% | 99.97% | 0.02% |
| nogRNA-G1333spilt-KKH-Cas9-G1333-C and dSpCas9-G1333-N | C | 0.00% | 0.00% | 99.99% | 99.98% | 99.99% | 99.99% | 0.01% | 99.97% |
| nogRNA-G1333spilt-KKH-Cas9-G1333-C and dSpCas9-G1333-N | G | 0.01% | 99.97% | 0.00% | 0.00% | 0.00% | 0.00% | 0.01% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.02% | 0.02% | 0.00% | 0.00% | 0.00% | 0.00% | 0.02% | 0.01% |
| nogRNA-G1371spilt-KKH-Cas9-G1371-N and dSpCas9-G1371-C | T | 99.92% | 0.01% | 0.02% | 0.00% | 0.00% | 0.02% | 99.97% | 0.01% |
| nogRNA-G1371spilt-KKH-Cas9-G1371-N and dSpCas9-G1371-C | C | 0.04% | 0.00% | 99% | 99.99% | 99.99% | 99.97% | 0.01% | 99.98% |

TABLE 10C-continued

| | | No gRNA | | | | | | | |
|---|---|---|---|---|---|---|---|---|---|
| nogRNA-G1371spilt-KKH-Cas9-G1371-N and dSpCas9-G1371-C | G | 0.01% | 99.96% | 0.00% | 0.00% | 0.00% | 0.00% | 0.00% | 0.00% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.01% | 0.00% | 0.00% |
| nogRNA-G1371spilt-KKH-Cas9-G1371-C and dSpCas9-G1371-N | A | 0.01% | 0.01% | 0.00% | 0.01% | 0.01% | 0.01% | 0.01% | 0.00% |
| nogRNA-G1371spilt-KKH-Cas9-G1371-C and dSpCas9-G1371-N | T | 99.92% | 0.01% | 0.01% | 0.02% | 0.01% | 0.01% | 99.92% | 0.01% |
| nogRNA-G1371spilt-KKH-Cas9-G1371-C and dSpCas9-G1371-N | C | 0.02% | 0.00% | 99.96% | 99.94% | 99.95% | 99.94% | 0.04% | 99.95% |
| nogRNA-G1371spilt-KKH-Cas9-G1371-C and dSpCas9-G1371-N | G | 0.01% | 99.94% | 0.00% | 0.00% | 0.00% | 0.00% | 0.01% | 0.00% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.03% | 0.03% | 0.03% | 0.03% | 0.03% | 0.04% | 0.03% | 0.02% |
| nogRNA-G1397spilt-KKH-Cas9-G1397-N and dSpCas9-G1397-C | A | 0.00% | 0.02% | 0.00% | 0.01% | 0.02% | 0.01% | 0.00% | 0.02% |
| nogRNA-G1397spilt-KKH-Cas9-G1397-N and dSpCas9-G1397-C | T | 99.62% | 0.00% | 0.01% | 0.01% | 0.01% | 0.01% | 99.63% | 0.00% |
| nogRNA-G1397spilt-KKH-Cas9-G1397-N and dSpCas9-G1397-C | C | 0.02% | 0.01% | 99.65% | 99.64% | 99.64% | 99.64% | 0.02% | 99.64% |
| nogRNA-G1397spilt-KKH-Cas9-G1397-N and dSpCas9-G1397-C | G | 0.02% | 99.63% | 0.00% | 0.00% | 0.00% | 0.00% | 0.01% | 0.00% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.33% | 0.33% | 0.33% | 0.33% | 0.33% | 0.34% | 0.34% | 0.34% |
| nogRNA-G1397spilt-KKH-Cas9-G1397-C and dSpCas9-G1397-N | A | 0.01% | 0.02% | 0.00% | 0.01% | 0.02% | 0.01% | 0.02% | 0.01% |
| nogRNA-G1397spilt-KKH-Cas9-G1397-C and dSpCas9-G1397-N | T | 99.95% | 0.00% | 0.01% | 0.00% | 0.01% | 0.01% | 99.93% | 0.07% |
| nogRNA-G1397spilt-KKH-Cas9-G1397-C and dSpCas9-G1397-N | C | 0.01% | 0.01% | 99.96% | 99.97% | 99.95% | 99.93% | 0.02% | 99.89% |
| nogRNA-G1397spilt-KKH-Cas9-G1397-C and dSpCas9-G1397-N | G | 0.01% | 99.95% | 0.00% | 0.00% | 0.00% | 0.00% | 0.01% | 0.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.02% | 0.02% | 0.02% | 0.02% | 0.02% | 0.04% | 0.02% | 0.02% |
| nogRNA-N1357spilt-KKH-Cas9-N1357-N and dSpCas9-N1357-C | A | 0.01% | 0.03% | 0.01% | 0.01% | 0.00% | 0.01% | 0.01% | 0.00% |
| nogRNA-N1357spilt-KKH-Cas9-N1357-N and dSpCas9-N1357-C | T | 99.96% | 0.01% | 0.02% | 0.00% | 0.00% | 0.01% | 99.97% | 0.02% |
| nogRNA-N1357spilt-KKH-Cas9-N1357-N and dSpCas9-N1357-C | C | 0.02% | 0.00% | 99.97% | 99.98% | 99.99% | 99.97% | 0.01% | 99.97% |
| nogRNA-N1357spilt-KKH-Cas9-N1357-N and dSpCas9-N1357-C | G | 0.02% | 99.96% | 0.00% | 0.00% | 0.01% | 0.00% | 0.00% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |

TABLE 10C-continued

| | | No gRNA | | | | | | | |
|---|---|---|---|---|---|---|---|---|---|
| nogRNA-N1357spilt-KKH-Cas9-N1357-N and dSpCas9-N1357-C | — | 0.00% | 0.00% | 0.00% | 0.00% | 0.00% | 0.01% | 0.01% | 0.00% |
| nogRNA-N1357spilt-KKH-Cas9-N1357-C and dSpCas9-N1357-N | A | 0.01% | 0.02% | 0.00% | 0.02% | 0.01% | 0.00% | 0.02% | 0.01% |
| nogRNA-N1357spilt-KKH-Cas9-N1357-C and dSpCas9-N1357-N | T | 99.97% | 0.00% | 0.01% | 0.01% | 0.01% | 0.01% | 99.93% | 0.03% |
| nogRNA-N1357spilt-KKH-Cas9-N1357-C and dSpCas9-N1357-N | C | 0.02% | 0.01% | 99.99% | 99.97% | 99.99% | 99.98% | 0.04% | 99.97% |
| nogRNA-N1357spilt-KKH-Cas9-N1357-C and dSpCas9-N1357-N | G | 0.01% | 99.97% | 0.00% | 0.00% | 0.00% | 0.00% | 0.01% | 0.00% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.01% | 0.00% | 0.00% |
| nogRNA-N1387spilt-KKH-Cas9-N1387-N and dSpCas9-N1387-C | A | 0.02% | 0.02% | 0.01% | 0.00% | 0.02% | 0.02% | 0.01% | 0.01% |
| nogRNA-N1387spilt-KKH-Cas9-N1387-N and dSpCas9-N1387-C | T | 99.92% | 0.00% | 0.00% | 0.03% | 0.01% | 0.01% | 99.93% | 0.03% |
| nogRNA-N1387spilt-KKH-Cas9-N1387-N and dSpCas9-N1387-C | C | 0.03% | 0.01% | 99.96% | 99.94% | 99.95% | 99.92% | 0.03% | 99.93% |
| nogRNA-N1387spilt-KKH-Cas9-N1387-N and dSpCas9-N1387-C | G | 0.01% | 99.94% | 0.00% | 0.01% | 0.00% | 0.02% | 0.00% | 0.00% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.02% | 0.02% | 0.02% | 0.02% | 0.02% | 0.04% | 0.02% | 0.02% |
| nogRNA-N1387spilt-KKH-Cas9-N1387-C and dSpCas9-N1387-N | A | 0.01% | 0.04% | 0.01% | 0.01% | 0.02% | 0.01% | 0.01% | 0.00% |
| nogRNA-N1387spilt-KKH-Cas9-N1387-C and dSpCas9-N1387-N | T | 99.95% | 0.01% | 0.01% | 0.01% | 0.01% | 0.00% | 99.96% | 0.04% |
| nogRNA-N1387spilt-KKH-Cas9-N1387-C and dSpCas9-N1387-N | C | 0.01% | 0.00% | 99.96% | 99.96% | 99.96% | 99.96% | 0.00% | 99.95% |
| nogRNA-N1387spilt-KKH-Cas9-N1387-C and dSpCas9-N1387-N | G | 0.02% | 99.94% | 0.01% | 0.00% | 0.00% | 0.00% | 0.01% | 0.00% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.01% | 0.01% | 0.01% | 0.02% | 0.01% | 0.01% |

| Batch | Nucleotide | C | C | T | C | C | C | T |
|---|---|---|---|---|---|---|---|---|
| nogRNA-A1343spilt-KKH-Cas9-A1343-N and dSpCas9-A1343-C | A | 0.00% | 0.01% | 0.00% | 0.01% | 0.01% | 0.02% | 0.01% |
| nogRNA-A1343spilt-KKH-Cas9-A1343-N and dSpCas9-A1343-C | T | 0.01% | 0.02% | 99.97% | 0.02% | 0.00% | 0.01% | 99.94% |
| nogRNA-A1343spilt-KKH-Cas9-A1343-N and dSpCas9-A1343-C | C | 99.98% | 99.95% | 0.02% | 99.96% | 99.98% | 99.96% | 0.02% |
| nogRNA-A1343spilt-KKH-Cas9-A1343-N and dSpCas9-A1343-C | G | 0.00% | 0.00% | 0.00% | 0.00% | 0.00% | 0.00% | 0.02% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.01% | 0.00% | 0.00% | 0.00% | 0.01% | 0.01% |

TABLE 10C-continued

| | | No gRNA | | | | | | |
|---|---|---|---|---|---|---|---|---|
| nogRNA-A1343spilt-KKH-Cas9-A1343-C and dSpCas9-A1343-N | A | 0.01% | 0.03% | 0.02% | 0.01% | 0.00% | 0.01% | 0.01% |
| nogRNA-A1343spilt-KKH-Cas9-A1343-C and dSpCas9-A1343-N | T | 0.01% | 0.01% | 99.95% | 0.01% | 0.02% | 0.00% | 99.92% |
| nogRNA-A1343spilt-KKH-Cas9-A1343-C and dSpCas9-A1343-N | C | 99.98% | 99.95% | 0.03% | 99.97% | 99.96% | 99.97% | 0.04% |
| nogRNA-A1343spilt-KKH-Cas9-A1343-C and dSpCas9-A1343-N | G | 0.00% | 0.00% | 0.00% | 0.00% | 0.00% | 0.00% | 0.02% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.01% | 0.02% | 0.01% |
| nogRNA-G1322spilt-KKH-Cas9-G1322-N and dSpCas9-G1322-C | A | 0.02% | 0.01% | 0.01% | 0.01% | 0.01% | 0.02% | 0.02% |
| nogRNA-G1322spilt-KKH-Cas9-G1322-N and dSpCas9-G1322-C | T | 0.03% | 0.01% | 99.97% | 0.02% | 0.02% | 0.01% | 99.92% |
| nogRNA-G1322spilt-KKH-Cas9-G1322-N and dSpCas9-G1322-C | C | 99.95% | 99.97% | 0.02% | 99.96% | 99.96% | 99.95% | 0.04% |
| nogRNA-G1322spilt-KKH-Cas9-G1322-N and dSpCas9-G1322-C | G | 0.00% | 0.00% | 0.01% | 0.00% | 0.00% | 0.00% | 0.00% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.01% | 0.00% | 0.01% | 0.01% | 0.02% | 0.02% |
| nogRNA-G1322spilt-KKH-Cas9-G1322-C and dSpCas9-G1322-N | A | 0.00% | 0.01% | 0.05% | 0.02% | 0.01% | 0.02% | 0.01% |
| nogRNA-G1322spilt-KKH-Cas9-G1322-C and dSpCas9-G1322-N | T | 0.01% | 0.01% | 99.93% | 0.10% | 0.00% | 0.02% | 99.92% |
| nogRNA-G1322spilt-KKH-Cas9-G1322-C and dSpCas9-G1322-N | C | 99.98% | 99.96% | 0.02% | 99.87% | 99.97% | 99.95% | 0.04% |
| nogRNA-G1322spilt-KKH-Cas9-G1322-C and dSpCas9-G1322-N | G | 0.00% | 0.00% | 0.00% | 0.00% | 0.00% | 0.00% | 0.02% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.01% | 0.02% | 0.01% | 0.01% | 0.00% | 0.01% | 0.01% |
| nogRNA-G1333spilt-KKH-Cas9-G1333-N and dSpCas9-G1333-C | A | 0.02% | 0.01% | 0.01% | 0.01% | 0.00% | 0.03% | 0.00% |
| nogRNA-G1333spilt-KKH-Cas9-G1333-N and dSpCas9-G1333-C | T | 0.03% | 0.01% | 99.96% | 0.03% | 0.02% | 0.01% | 99.91% |
| nogRNA-G1333spilt-KKH-Cas9-G1333-N and dSpCas9-G1333-C | C | 99.95% | 99.97% | 0.02% | 99.95% | 99.97% | 99.94% | 0.04% |
| nogRNA-G1333spilt-KKH-Cas9-G1333-N and dSpCas9-G1333-C | G | 0.00% | 0.00% | 0.00% | 0.00% | 0.00% | 0.00% | 0.04% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.01% | 0.01% | 0.01% | 0.01% | 0.01% | 0.01% |
| nogRNA-G1333spilt-KKH-Cas9-G1333-C and dSpCas9-G1333-N | A | 0.00% | 0.01% | 0.01% | 0.01% | 0.02% | 0.00% | 0.01% |
| nogRNA-G1333spilt-KKH-Cas9-G1333-C and dSpCas9-G1333-N | T | 0.01% | 0.01% | 99.96% | 0.03% | 0.01% | 0.01% | 99.90% |

TABLE 10C-continued

| No gRNA | | | | | | | | |
|---|---|---|---|---|---|---|---|---|
| nogRNA-G1333spilt-KKH-Cas9-G1333-C and dSpCas9-G1333-N | C | 99.99% | 99.96% | 0.01% | 99.91% | 99.90% | 99.93% | 0.04% |
| nogRNA-G1333spilt-KKH-Cas9-G1333-C and dSpCas9-G1333-N | G | 0.00% | 0.00% | 0.01% | 0.00% | 0.01% | 0.00% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.02% | 0.00% | 0.05% | 0.05% | 0.05% | 0.05% |
| nogRNA-G1371spilt-KKH-Cas9-G1371-N and dSpCas9-G1371-C | A | 0.00% | 0.02% | 0.01% | 0.00% | 0.01% | 0.02% | 0.00% |
| nogRNA-G1371spilt-KKH-Cas9-G1371-N and dSpCas9-G1371-C | T | 0.02% | 0.01% | 99.96% | 0.02% | 0.01% | 0.00% | 99.92% |
| nogRNA-G1371spilt-KKH-Cas9-G1371-N and dSpCas9-G1371-C | C | 99.97% | 99.95% | 0.02% | 99.95% | 99.94% | 99.94% | 0.02% |
| nogRNA-G1371spilt-KKH-Cas9-G1371-N and dSpCas9-G1371-C | G | 0.00% | 0.00% | 0.00% | 0.00% | 0.00% | 0.00% | 0.02% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.01% | 0.01% | 0.03% | 0.03% | 0.04% | 0.04% |
| nogRNA-G1371spilt-KKH-Cas9-G1371-C and dSpCas9-G1371-N | A | 0.00% | 0.02% | 0.02% | 0.01% | 0.00% | 0.01% | 0.01% |
| nogRNA-G1371spilt-KKH-Cas9-G1371-C and dSpCas9-G1371-N | T | 0.02% | 0.01% | 99.92% | 0.01% | 0.02% | 0.01% | 99.93% |
| nogRNA-G1371spilt-KKH-Cas9-G1371-C and dSpCas9-G1371-N | C | 99.95% | 99.95% | 0.03% | 99.96% | 99.95% | 99.95% | 0.03% |
| nogRNA-G1371spilt-KKH-Cas9-G1371-C and dSpCas9-G1371-N | G | 0.00% | 0.00% | 0.01% | 0.00% | 0.00% | 0.00% | 0.01% |
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.02% | 0.02% | 0.02% | 0.02% | 0.02% | 0.02% | 0.02% |
| nogRNA-G1397spilt-KKH-Cas9-G1397-N and dSpCas9-G1397-C | A | 0.00% | 0.01% | 0.01% | 0.01% | 0.02% | 0.00% | 0.01% |
| nogRNA-G1397spilt-KKH-Cas9-G1397-N and dSpCas9-G1397-C | T | 0.01% | 0.00% | 99.62% | 0.02% | 0.00% | 0.00% | 99.58% |
| nogRNA-G1397spilt-KKH-Cas9-G1397-N and dSpCas9-G1397-C | C | 99.65% | 99.66% | 0.02% | 99.61% | 99.62% | 99.64% | 0.02% |
| nogRNA-G1397spilt-KKH-Cas9-G1397-N and dSpCas9-G1397-C | G | 0.00% | 0.00% | 0.01% | 0.00% | 0.00% | 0.00% | 0.02% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.34% | 0.34% | 0.34% | 0.36% | 0.36% | 0.36% | 0.36% |
| nogRNA-G1397spilt-KKH-Cas9-G1397-C and dSpCas9-G1397-N | A | 0.02% | 0.01% | 0.01% | 0.01% | 0.00% | 0.01% | 0.01% |
| nogRNA-G1397spilt-KKH-Cas9-G1397-C and dSpCas9-G1397-N | T | 0.04% | 0.03% | 99.93% | 0.06% | 0.05% | 0.04% | 99.91% |
| nogRNA-G1397spilt-KKH-Cas9-G1397-C and dSpCas9-G1397-N | C | 99.91% | 99.93% | 0.03% | 99.90% | 99.93% | 99.92% | 0.04% |
| nogRNA-G1397spilt-KKH-Cas9-G1397-C and dSpCas9-G1397-N | G | 0.00% | 0.00% | 0.00% | 0.00% | 0.00% | 0.00% | 0.01% |

TABLE 10C-continued

| No gRNA | | | | | | | | |
|---|---|---|---|---|---|---|---|---|
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.02% | 0.02% | 0.02% | 0.03% | 0.02% | 0.03% | 0.03% |
| nogRNA-N1357spilt-KKH-Cas9-N1357-N and dSpCas9-N1357-C | A | 0.01% | 0.01% | 0.00% | 0.00% | 0.02% | 0.03% | 0.01% |
| nogRNA-N1357spilt-KKH-Cas9-N1357-N and dSpCas9-N1357-C | T | 0.03% | 0.01% | 99.99% | 0.02% | 0.03% | 0.00% | 99.91% |
| nogRNA-N1357spilt-KKH-Cas9-N1357-N and dSpCas9-N1357-C | C | 99.96% | 99.96% | 0.00% | 99.96% | 99.92% | 99.95% | 0.04% |
| nogRNA-N1357spilt-KKH-Cas9-N1357-N and dSpCas9-N1357-C | G | 0.00% | 0.01% | 0.00% | 0.00% | 0.01% | 0.00% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.02% | 0.01% | 0.02% | 0.02% | 0.02% | 0.02% |
| nogRNA-N1357spilt-KKH-Cas9-N1357-C and dSpCas9-N1357-N | A | 0.00% | 0.02% | 0.01% | 0.01% | 0.01% | 0.03% | 0.01% |
| nogRNA-N1357spilt-KKH-Cas9-N1357-C and dSpCas9-N1357-N | T | 0.02% | 0.01% | 99.96% | 0.02% | 0.02% | 0.00% | 99.95% |
| nogRNA-N1357spilt-KKH-Cas9-N1357-C and dSpCas9-N1357-N | C | 99.97% | 99.96% | 0.03% | 99.97% | 99.97% | 99.94% | 0.03% |
| nogRNA-N1357spilt-KKH-Cas9-N1357-C and dSpCas9-N1357-N | G | 0.01% | 0.00% | 0.00% | 0.00% | 0.00% | 0.01% | 0.01% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.01% | 0.01% | 0.01% | 0.01% | 0.02% | 0.01% |
| nogRNA-N1387spilt-KKH-Cas9-N1387-N and dSpCas9-N1387-C | A | 0.01% | 0.02% | 0.00% | 0.02% | 0.02% | 0.01% | 0.00% |
| nogRNA-N1387spilt-KKH-Cas9-N1387-N and dSpCas9-N1387-C | T | 0.02% | 0.01% | 99.93% | 0.06% | 0.05% | 0.03% | 99.92% |
| nogRNA-N1387spilt-KKH-Cas9-N1387-N and dSpCas9-N1387-C | C | 99.94% | 99.94% | 0.04% | 99.89% | 99.89% | 99.91% | 0.03% |
| nogRNA-N1387spilt-KKH-Cas9-N1387-N and dSpCas9-N1387-C | G | 0.00% | 0.00% | 0.00% | 0.00% | 0.01% | 0.00% | 0.02% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.02% | 0.03% | 0.02% | 0.03% | 0.04% | 0.04% | 0.04% |
| nogRNA-N1387spilt-KKH-Cas9-N1387-C and dSpCas9-N1387-N | A | 0.01% | 0.01% | 0.00% | 0.01% | 0.04% | 0.01% | 0.00% |
| nogRNA-N1387spilt-KKH-Cas9-N1387-C and dSpCas9-N1387-N | T | 0.04% | 0.04% | 99.95% | 0.02% | 0.04% | 0.02% | 99.93% |
| nogRNA-N1387spilt-KKH-Cas9-N1387-C and dSpCas9-N1387-N | C | 99.94% | 99.93% | 0.03% | 99.94% | 99.90% | 99.95% | 0.05% |
| nogRNA-N1387spilt-KKH-Cas9-N1387-C and dSpCas9-N1387-N | G | 0.00% | 0.00% | 0.00% | 0.01% | 0.00% | 0.00% | 0.01% |
| nogRNA-N1387spilt-KKH-Cas9-N1387-C and dSpCas9-N1387-N | N | 0.00% | 0.00% | 0.00% | 0.00% | 0.00% | 0.00% | 0.00% |

TABLE 10C-continued

| | | | | | | | | | |
|---|---|---|---|---|---|---|---|---|---|
| No gRNA | | | | | | | | | |
| nogRNA-N1387spilt-KKH-Cas9-N1387-C and dSpCas9-N1387-N | — | 0.01% | 0.02% | 0.02% | 0.02% | 0.02% | 0.01% | 0.01% | |

| Batch | Nucleotide | G | G | C | C | C | A | G | G | T |
|---|---|---|---|---|---|---|---|---|---|---|
| nogRNA-A1343spilt-KKH-Cas9-A1343-N and dSpCas9-A1343-C | A | 0.01% | 0.00% | 0.01% | 0.01% | 0.01% | 99.93% | 0.00% | 0.01% | 0.00% |
| nogRNA-A1343spilt-KKH-Cas9-A1343-N and dSpCas9-A1343-C | T | 0.01% | 0.00% | 0.01% | 0.01% | 0.01% | 0.02% | 0.01% | 0.00% | 99.77% |
| nogRNA-A1343spilt-KKH-Cas9-A1343-N and dSpCas9-A1343-C | C | 0.00% | 0.00% | 99.98% | 99.98% | 99.98% | 0.00% | 0.00% | 0.00% | 0.05% |
| nogRNA-A1343spilt-KKH-Cas9-A1343-N and dSpCas9-A1343-C | G | 99.98% | 100.00% | 0.01% | 0.00% | 0.00% | 0.05% | 99.98% | 99.98% | 0.17% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.02% | 0.00% | 0.00% | 0.00% | 0.01% | 99.84% | 0.00% | 0.01% | 0.00% |
| nogRNA-A1343spilt-KKH-Cas9-A1343-C and dSpCas9-A1343-N | T | 0.00% | 0.01% | 0.01% | 0.01% | 0.01% | 0.00% | 0.01% | 0.00% | 99.71% |
| nogRNA-A1343spilt-KKH-Cas9-A1343-C and dSpCas9-A1343-N | C | 0.00% | 0.00% | 99.99% | 99.98% | 99.97% | 0.08% | 0.00% | 0.00% | 0.04% |
| nogRNA-A1343spilt-KKH-Cas9-A1343-C and dSpCas9-A1343-N | G | 99.98% | 99.98% | 0.00% | 0.00% | 0.00% | 0.08% | 99.99% | 99.98% | 0.25% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.01% | 0.00% | 0.00% | 0.00% | 0.00% |
| nogRNA-G1322spilt-KKH-Cas9-G1322-N and dSpCas9-G1322-C | A | 0.02% | 0.01% | 0.00% | 0.00% | 0.03% | 99.90% | 0.00% | 0.01% | 0.03% |
| nogRNA-G1322spilt-KKH-Cas9-G1322-N and dSpCas9-G1322-C | T | 0.00% | 0.00% | 0.02% | 0.01% | 0.02% | 0.02% | 0.01% | 0.00% | 99.74% |
| nogRNA-G1322spilt-KKH-Cas9-G1322-N and dSpCas9-G1322-C | C | 0.00% | 0.01% | 99.97% | 99.98% | 99.95% | 0.02% | 0.01% | 0.00% | 0.05% |
| nogRNA-G1322spilt-KKH-Cas9-G1322-N and dSpCas9-G1322-C | G | 99.98% | 99.98% | 0.01% | 0.01% | 0.00% | 0.06% | 99.98% | 99.99% | 0.19% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 0.02% | 0.00% | 0.01% | 0.02% | 99.92% | 0.01% | 0.00% | 0.02% |
| nogRNA-G1322spilt-KKH-Cas9-G1322-C and dSpCas9-G1322-N | T | 0.01% | 0.00% | 0.01% | 0.01% | 0.02% | 0.01% | 0.01% | 0.00% | 99.71% |
| nogRNA-G1322spilt-KKH-Cas9-G1322-C and dSpCas9-G1322-N | C | 0.00% | 0.00% | 99.96% | 99.97% | 99.95% | 0.01% | 0.00% | 0.00% | 0.05% |
| nogRNA-G1322spilt-KKH-Cas9-G1322-C and dSpCas9-G1322-N | G | 99.98% | 99.97% | 0.02% | 0.00% | 0.00% | 0.05% | 99.97% | 99.99% | 0.22% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.01% | 0.00% | 0.00% | 0.01% | 0.00% | 0.00% | 0.00% | 0.00% |

TABLE 10C-continued

| | | No gRNA | | | | | | | | |
|---|---|---|---|---|---|---|---|---|---|---|
| nogRNA-G1333spilt-KKH-Cas9-G1333-N and dSpCas9-G1333-C | A | 0.03% | 0.03% | 0.00% | 0.00% | 0.00% | 99.91% | 0.00% | 0.00% | 0.02% |
| nogRNA-G1333spilt-KKH-Cas9-G1333-N and dSpCas9-G1333-C | T | 0.00% | 0.00% | 0.01% | 0.02% | 0.03% | 0.02% | 0.02% | 0.00% | 99.70% |
| nogRNA-G1333spilt-KKH-Cas9-G1333-N and dSpCas9-G1333-C | C | 0.00% | 0.00% | 99.97% | 99.96% | 99.96% | 0.03% | 0.00% | 0.00% | 0.06% |
| nogRNA-G1333spilt-KKH-Cas9-G1333-N and dSpCas9-G1333-C | G | 99.97% | 99.96% | 0.02% | 0.01% | 0.00% | 0.04% | 99.98% | 99.99% | 0.21% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.01% | 0.00% | 0.00% | 0.01% | 0.00% | 0.00% | 0.00% | 0.01% |
| nogRNA-G1333spilt-KKH-Cas9-G1333-C and dSpCas9-G1333-N | A | 0.01% | 0.00% | 0.01% | 0.00% | 0.00% | 99.88% | 0.00% | 0.00% | 0.01% |
| nogRNA-G1333spilt-KKH-Cas9-G1333-C and dSpCas9-G1333-N | T | 0.00% | 0.01% | 0.02% | 0.00% | 0.03% | 0.01% | 0.01% | 0.01% | 99.69% |
| nogRNA-G1333spilt-KKH-Cas9-G1333-C and dSpCas9-G1333-N | C | 0.00% | 0.00% | 99.95% | 99.99% | 99.95% | 0.02% | 0.00% | 0.00% | 0.07% |
| nogRNA-G1333spilt-KKH-Cas9-G1333-C and dSpCas9-G1333-N | G | 99.99% | 99.98% | 0.02% | 0.00% | 0.01% | 0.09% | 99.99% | 99.99% | 0.22% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.02% | 0.00% | 0.00% | 0.00% | 0.02% | 99.91% | 0.00% | 0.01% | 0.02% |
| nogRNA-G1371spilt-KKH-Cas9-G1371-N and dSpCas9-G1371-C | T | 0.00% | 0.00% | 0.04% | 0.02% | 0.02% | 0.02% | 0.01% | 0.00% | 99.71% |
| nogRNA-G1371spilt-KKH-Cas9-G1371-N and dSpCas9-G1371-C | C | 0.00% | 0.00% | 99.94% | 99.97% | 99.95% | 0.01% | 0.00% | 0.00% | 0.08% |
| nogRNA-G1371spilt-KKH-Cas9-G1371-N and dSpCas9-G1371-C | G | 99.97% | 99.98% | 0.01% | 0.00% | 0.00% | 0.06% | 99.98% | 99.98% | 0.19% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.01% | 0.01% | 0.01% | 0.02% | 0.01% | 0.01% | 0.00% | 0.00% |
| nogRNA-G1371spilt-KKH-Cas9-G1371-C and dSpCas9-G1371-N | A | 0.01% | 0.01% | 0.00% | 0.01% | 0.01% | 99.89% | 0.00% | 0.00% | 0.01% |
| nogRNA-G1371spilt-KKH-Cas9-G1371-C and dSpCas9-G1371-N | T | 0.00% | 0.01% | 0.03% | 0.02% | 0.02% | 0.02% | 0.02% | 0.00% | 99.73% |
| nogRNA-G1371spilt-KKH-Cas9-G1371-C and dSpCas9-G1371-N | C | 0.00% | 0.01% | 99.96% | 99.96% | 99.95% | 0.03% | 0.00% | 0.00% | 0.06% |
| nogRNA-G1371spilt-KKH-Cas9-G1371-C and dSpCas9-G1371-N | G | 99.98% | 99.96% | 0.00% | 0.01% | 0.00% | 0.06% | 99.98% | 99.99% | 0.20% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.01% | 0.01% | 0.00% | 0.00% | 0.01% | 0.00% | 0.00% | 0.00% | 0.01% |
| nogRNA-G1397spilt-KKH-Cas9-G1397-N and dSpCas9-G1397-C | A | 0.00% | 0.02% | 0.00% | 0.01% | 0.02% | 99.62% | 0.02% | 0.01% | 0.01% |
| nogRNA-G1397spilt-KKH-Cas9-G1397-N and dSpCas9-G1397-C | T | 0.00% | 0.00% | 0.05% | 0.03% | 0.01% | 0.02% | 0.00% | 0.00% | 99.53% |

TABLE 10C-continued

| | | No gRNA | | | | | | | | |
|---|---|---|---|---|---|---|---|---|---|---|
| nogRNA-G1397spilt-KKH-Cas9-G1397-N and dSpCas9-G1397-C | C | 0.00% | 0.00% | 99.61% | 99.64% | 99.65% | 0.01% | 0.00% | 0.00% | 0.09% |
| nogRNA-G1397spilt-KKH-Cas9-G1397-N and dSpCas9-G1397-C | G | 99.66% | 99.65% | 0.01% | 0.00% | 0.00% | 0.04% | 99.66% | 99.81% | 0.19% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.33% | 0.33% | 0.32% | 0.32% | 0.32% | 0.31% | 0.31% | 0.18% | 0.18% |
| nogRNA-G1397spilt-KKH-Cas9-G1397-C and dSpCas9-G1397-N | A | 0.02% | 0.02% | 0.00% | 0.00% | 0.01% | 99.90% | 0.00% | 0.02% | 0.01% |
| nogRNA-G1397spilt-KKH-Cas9-G1397-C and dSpCas9-G1397-N | T | 0.00% | 0.00% | 0.04% | 0.02% | 0.01% | 0.00% | 0.01% | 0.00% | 99.71% |
| nogRNA-G1397spilt-KKH-Cas9-G1397-C and dSpCas9-G1397-N | C | 0.00% | 0.00% | 99.94% | 99.96% | 99.97% | 0.01% | 0.00% | 0.00% | 0.06% |
| nogRNA-G1397spilt-KKH-Cas9-G1397-C and dSpCas9-G1397-N | G | 99.95% | 99.96% | 0.01% | 0.01% | 0.00% | 0.07% | 99.97% | 99.97% | 0.20% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.02% | 0.01% | 0.01% | 0.01% | 0.02% | 0.02% | 0.01% | 0.01% | 0.01% |
| nogRNA-N1357spilt-KKH-Cas9-N1357-N and dSpCas9-N1357-C | A | 0.01% | 0.01% | 0.00% | 0.00% | 0.01% | 99.91% | 0.01% | 0.02% | 0.03% |
| nogRNA-N1357spilt-KKH-Cas9-N1357-N and dSpCas9-N1357-C | T | 0.01% | 0.02% | 0.02% | 0.02% | 0.02% | 0.01% | 0.00% | 0.00% | 99.71% |
| nogRNA-N1357spilt-KKH-Cas9-N1357-N and dSpCas9-N1357-C | C | 0.00% | 0.00% | 99.95% | 99.97% | 99.97% | 0.02% | 0.00% | 0.00% | 0.08% |
| nogRNA-N1357spilt-KKH-Cas9-N1357-N and dSpCas9-N1357-C | G | 99.98% | 99.97% | 0.03% | 0.00% | 0.00% | 0.05% | 99.99% | 99.98% | 0.18% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.01% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.02% | 0.02% | 0.01% | 0.00% | 0.01% | 99.83% | 0.00% | 0.01% | 0.01% |
| nogRNA-N1357spilt-KKH-Cas9-N1357-C and dSpCas9-N1357-N | T | 0.00% | 0.00% | 0.01% | 0.01% | 0.00% | 0.02% | 0.00% | 0.00% | 99.63% |
| nogRNA-N1357spilt-KKH-Cas9-N1357-C and dSpCas9-N1357-N | C | 0.01% | 0.01% | 99.97% | 99.98% | 99.98% | 0.07% | 0.00% | 0.00% | 0.03% |
| nogRNA-N1357spilt-KKH-Cas9-N1357-C and dSpCas9-N1357-N | G | 99.98% | 99.98% | 0.02% | 0.01% | 0.01% | 0.09% | 100.00% | 99.99% | 0.32% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.01% | 0.00% | 0.00% | 0.00% | 0.01% |
| nogRNA-N1387spilt-KKH-Cas9-N1387-N and dSpCas9-N1387-C | A | 0.02% | 0.02% | 0.00% | 0.01% | 0.02% | 99.86% | 0.01% | 0.01% | 0.02% |
| nogRNA-N1387spilt-KKH-Cas9-N1387-N and dSpCas9-N1387-C | T | 0.01% | 0.02% | 0.03% | 0.02% | 0.03% | 0.02% | 0.01% | 0.00% | 99.69% |
| nogRNA-N1387spilt-KKH-Cas9-N1387-N and dSpCas9-N1387-C | C | 0.01% | 0.00% | 99.93% | 99.94% | 99.91% | 0.01% | 0.00% | 0.00% | 0.04% |
| nogRNA-N1387spilt-KKH-Cas9-N1387-N and dSpCas9-N1387-C | G | 99.92% | 99.93% | 0.00% | 0.00% | 0.00% | 0.08% | 99.96% | 99.98% | 0.25% |

TABLE 10C-continued

| | | | | | | | | | | |
|---|---|---|---|---|---|---|---|---|---|---|
| No gRNA | | | | | | | | | | |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.03% | 0.04% | 0.03% | 0.03% | 0.04% | 0.02% | 0.02% | 0.01% | 0.01% |
| nogRNA-N1387spilt-KKH-Cas9-N1387-C and dSpCas9-N1387-N | A | 0.02% | 0.01% | 0.00% | 0.01% | 0.01% | 99.91% | 0.00% | 0.00% | 0.01% |
| nogRNA-N1387spilt-KKH-Cas9-N1387-C and dSpCas9-N1387-N | T | 0.00% | 0.00% | 0.02% | 0.01% | 0.01% | 0.02% | 0.00% | 0.00% | 99.71% |
| nogRNA-N1387spilt-KKH-Cas9-N1387-C and dSpCas9-N1387-N | C | 0.00% | 0.00% | 99.96% | 99.97% | 99.96% | 0.03% | 0.00% | 0.00% | 0.06% |
| nogRNA-N1387spilt-KKH-Cas9-N1387-C and dSpCas9-N1387-N | G | 99.97% | 99.98% | 0.01% | 0.01% | 0.00% | 0.03% | 100.00% | 99.99% | 0.21% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.01% | 0.00% | 0.00% | 0.00% | 0.00% |

| Batch | Nucleotide | G | A | A | G | G | T | G | T |
|---|---|---|---|---|---|---|---|---|---|
| nogRNA-A1343spilt-KKH-Cas9-A1343-N and dSpCas9-A1343-C | A | 0.01% | 99.95% | 99.93% | 0.00% | 0.00% | 0.02% | 0.01% | 0.02% |
| nogRNA-A1343spilt-KKH-Cas9-A1343-N and dSpCas9-A1343-C | T | 0.01% | 0.00% | 0.00% | 0.00% | 0.01% | 99.74% | 0.01% | 99.93% |
| nogRNA-A1343spilt-KKH-Cas9-A1343-N and dSpCas9-A1343-C | C | 0.00% | 0.02% | 0.00% | 0.00% | 0.00% | 0.05% | 0.00% | 0.01% |
| nogRNA-A1343spilt-KKH-Cas9-A1343-N and dSpCas9-A1343-C | G | 99.98% | 0.02% | 0.05% | 99.99% | 99.99% | 0.19% | 99.98% | 0.04% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 99.86% | 99.83% | 0.01% | 0.01% | 0.02% | 0.01% | 0.00% |
| nogRNA-A1343spilt-KKH-Cas9-A1343-C and dSpCas9-A1343-N | T | 0.00% | 0.01% | 0.02% | 0.00% | 0.01% | 99.72% | 0.01% | 99.91% |
| nogRNA-A1343spilt-KKH-Cas9-A1343-C and dSpCas9-A1343-N | C | 0.00% | 0.07% | 0.07% | 0.00% | 0.00% | 0.05% | 0.00% | 0.01% |
| nogRNA-A1343spilt-KKH-Cas9-A1343-C and dSpCas9-A1343-N | G | 99.99% | 0.05% | 0.08% | 99.99% | 99.98% | 0.22% | 99.98% | 0.08% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.01% | 99.93% | 99.87% | 0.01% | 0.00% | 0.03% | 0.00% | 0.01% |
| nogRNA-G1322spilt-KKH-Cas9-G1322-N and dSpCas9-G1322-C | T | 0.02% | 0.01% | 0.01% | 0.01% | 0.02% | 99.76% | 0.02% | 99.93% |
| nogRNA-G1322spilt-KKH-Cas9-G1322-N and dSpCas9-G1322-C | C | 0.00% | 0.03% | 0.03% | 0.00% | 0.00% | 0.04% | 0.00% | 0.03% |
| nogRNA-G1322spilt-KKH-Cas9-G1322-N and dSpCas9-G1322-C | G | 99.98% | 0.02% | 0.09% | 99.98% | 99.98% | 0.17% | 99.98% | 0.03% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |

TABLE 10C-continued

| No gRNA | | | | | | | | | |
|---|---|---|---|---|---|---|---|---|---|
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.00% | 99.90% | 99.85% | 0.00% | 0.00% | 0.02% | 0.00% | 0.01% |
| nogRNA-G1322spilt-KKH-Cas9-G1322-C and dSpCas9-G1322-N | T | 0.02% | 0.02% | 0.03% | 0.01% | 0.01% | 99.70% | 0.02% | 99.90% |
| nogRNA-G1322spilt-KKH-Cas9-G1322-C and dSpCas9-G1322-N | C | 0.01% | 0.03% | 0.01% | 0.01% | 0.00% | 0.07% | 0.00% | 0.03% |
| nogRNA-G1322spilt-KKH-Cas9-G1322-C and dSpCas9-G1322-N | G | 99.97% | 0.06% | 0.11% | 99.98% | 99.99% | 0.21% | 99.98% | 0.05% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 99.95% | 99.89% | 0.00% | 0.01% | 0.03% | 0.00% | 0.01% |
| nogRNA-G1333spilt-KKH-Cas9-G1333-N and dSpCas9-G1333-C | T | 0.01% | 0.00% | 0.02% | 0.00% | 0.00% | 99.76% | 0.02% | 99.90% |
| nogRNA-G1333spilt-KKH-Cas9-G1333-N and dSpCas9-G1333-C | C | 0.00% | 0.02% | 0.03% | 0.00% | 0.00% | 0.05% | 0.00% | 0.03% |
| nogRNA-G1333spilt-KKH-Cas9-G1333-N and dSpCas9-G1333-C | G | 99.98% | 0.03% | 0.06% | 100.00% | 99.98% | 0.16% | 99.97% | 0.06% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 99.91% | 99.86% | 0.00% | 0.01% | 0.01% | 0.01% | 0.01% |
| nogRNA-G1333spilt-KKH-Cas9-G1333-C and dSpCas9-G1333-N | T | 0.01% | 0.00% | 0.01% | 0.00% | 0.01% | 99.75% | 0.02% | 99.94% |
| nogRNA-G1333spilt-KKH-Cas9-G1333-C and dSpCas9-G1333-N | C | 0.00% | 0.05% | 0.04% | 0.00% | 0.00% | 0.06% | 0.00% | 0.01% |
| nogRNA-G1333spilt-KKH-Cas9-G1333-C and dSpCas9-G1333-N | G | 99.99% | 0.03% | 0.10% | 99.99% | 99.98% | 0.18% | 99.97% | 0.04% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.01% | 99.92% | 99.90% | 0.02% | 0.02% | 0.03% | 0.02% | 0.02% |
| nogRNA-G1371spilt-KKH-Cas9-G1371-N and dSpCas9-G1371-C | T | 0.01% | 0.01% | 0.01% | 0.00% | 0.01% | 99.70% | 0.00% | 99.93% |
| nogRNA-G1371spilt-KKH-Cas9-G1371-N and dSpCas9-G1371-C | C | 0.00% | 0.03% | 0.03% | 0.00% | 0.00% | 0.05% | 0.00% | 0.02% |
| nogRNA-G1371spilt-KKH-Cas9-G1371-N and dSpCas9-G1371-C | G | 99.98% | 0.03% | 0.06% | 99.98% | 99.97% | 0.21% | 99.98% | 0.03% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.00% | 99.88% | 99.85% | 0.00% | 0.01% | 0.04% | 0.00% | 0.01% |

TABLE 10C-continued

| No gRNA | | | | | | | | | |
|---|---|---|---|---|---|---|---|---|---|
| nogRNA-G1371spilt-KKH-Cas9-G1371-C and dSpCas9-G1371-N | T | 0.02% | 0.02% | 0.02% | 0.01% | 0.02% | 99.65% | 0.05% | 99.88% |
| nogRNA-G1371spilt-KKH-Cas9-G1371-C and dSpCas9-G1371-N | C | 0.00% | 0.05% | 0.02% | 0.00% | 0.00% | 0.08% | 0.00% | 0.04% |
| nogRNA-G1371spilt-KKH-Cas9-G1371-C and dSpCas9-G1371-N | G | 99.97% | 0.05% | 0.12% | 99.99% | 99.97% | 0.23% | 99.95% | 0.07% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.00% | 99.72% | 99.73% | 0.00% | 0.00% | 0.03% | 0.01% | 0.02% |
| nogRNA-G1397spilt-KKH-Cas9-G1397-N and dSpCas9-G1397-C | T | 0.02% | 0.01% | 0.01% | 0.01% | 0.02% | 99.71% | 0.01% | 99.89% |
| nogRNA-G1397spilt-KKH-Cas9-G1397-N and dSpCas9-G1397-C | C | 0.00% | 0.03% | 0.02% | 0.00% | 0.00% | 0.05% | 0.00% | 0.02% |
| nogRNA-G1397spilt-KKH-Cas9-G1397-N and dSpCas9-G1397-C | G | 99.79% | 0.06% | 0.07% | 99.82% | 99.80% | 0.17% | 99.93% | 0.02% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.18% | 0.17% | 0.17% | 0.17% | 0.17% | 0.05% | 0.05% | 0.05% |
| nogRNA-G1397spilt-KKH-Cas9-G1397-C and dSpCas9-G1397-N | A | 0.00% | 99.92% | 99.90% | 0.01% | 0.00% | 0.03% | 0.01% | 0.00% |
| nogRNA-G1397spilt-KKH-Cas9-G1397-C and dSpCas9-G1397-N | T | 0.00% | 0.02% | 0.01% | 0.01% | 0.00% | 99.75% | 0.01% | 99.93% |
| nogRNA-G1397spilt-KKH-Cas9-G1397-C and dSpCas9-G1397-N | C | 0.00% | 0.02% | 0.02% | 0.00% | 0.00% | 0.06% | 0.00% | 0.03% |
| nogRNA-G1397spilt-KKH-Cas9-G1397-C and dSpCas9-G1397-N | G | 99.99% | 0.02% | 0.06% | 99.98% | 100.00% | 0.16% | 99.98% | 0.04% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.01% | 0.01% | 0.01% | 0.00% | 0.00% | 0.00% | 0.00% | 0.00% |
| nogRNA-N1357spilt-KKH-Cas9-N1357-N and dSpCas9-N1357-C | A | 0.00% | 99.90% | 99.89% | 0.00% | 0.00% | 0.05% | 0.01% | 0.00% |
| nogRNA-N1357spilt-KKH-Cas9-N1357-N and dSpCas9-N1357-C | T | 0.02% | 0.02% | 0.02% | 0.01% | 0.01% | 99.71% | 0.02% | 99.93% |
| nogRNA-N1357spilt-KKH-Cas9-N1357-N and dSpCas9-N1357-C | C | 0.00% | 0.05% | 0.02% | 0.00% | 0.00% | 0.06% | 0.00% | 0.02% |
| nogRNA-N1357spilt-KKH-Cas9-N1357-N and dSpCas9-N1357-C | G | 99.97% | 0.03% | 0.08% | 99.98% | 99.99% | 0.18% | 99.97% | 0.05% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.01% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.01% | 99.87% | 99.79% | 0.00% | 0.00% | 0.02% | 0.00% | 0.00% |
| nogRNA-N1357spilt-KKH-Cas9-N1357-C and dSpCas9-N1357-N | T | 0.00% | 0.01% | 0.01% | 0.02% | 0.01% | 99.74% | 0.02% | 99.90% |
| nogRNA-N1357spilt-KKH-Cas9-N1357-C and dSpCas9-N1357-N | C | 0.00% | 0.07% | 0.06% | 0.00% | 0.01% | 0.03% | 0.00% | 0.03% |

TABLE 10C-continued

| No gRNA | | | | | | | | | |
|---|---|---|---|---|---|---|---|---|---|
| nogRNA-N1357spilt-KKH-Cas9-N1357-C and dSpCas9-N1357-N | G | 99.99% | 0.06% | 0.14% | 99.98% | 99.99% | 0.22% | 99.98% | 0.07% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.02% | 99.89% | 99.85% | 0.01% | 0.01% | 0.02% | 0.01% | 0.01% |
| nogRNA-N1387spilt-KKH-Cas9-N1387-N and dSpCas9-N1387-C | T | 0.03% | 0.01% | 0.02% | 0.02% | 0.04% | 99.69% | 0.02% | 99.93% |
| nogRNA-N1387spilt-KKH-Cas9-N1387-N and dSpCas9-N1387-C | C | 0.00% | 0.06% | 0.03% | 0.00% | 0.00% | 0.06% | 0.00% | 0.01% |
| nogRNA-N1387spilt-KKH-Cas9-N1387-N and dSpCas9-N1387-C | G | 99.95% | 0.04% | 0.09% | 99.96% | 99.94% | 0.22% | 99.96% | 0.04% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.01% | 0.01% | 0.01% | 0.01% | 0.01% |
| nogRNA-N1387spilt-KKH-Cas9-N1387-C and dSpCas9-N1387-N | A | 0.00% | 99.91% | 99.89% | 0.00% | 0.00% | 0.02% | 0.00% | 0.00% |
| nogRNA-N1387spilt-KKH-Cas9-N1387-C and dSpCas9-N1387-N | T | 0.01% | 0.02% | 0.00% | 0.02% | 0.01% | 99.73% | 0.02% | 99.95% |
| nogRNA-N1387spilt-KKH-Cas9-N1387-C and dSpCas9-N1387-N | C | 0.00% | 0.04% | 0.02% | 0.00% | 0.00% | 0.07% | 0.00% | 0.02% |
| nogRNA-N1387spilt-KKH-Cas9-N1387-C and dSpCas9-N1387-N | G | 99.98% | 0.04% | 0.09% | 99.97% | 99.98% | 0.18% | 99.97% | 0.03% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% |

| Batch | Nucleotide | G | G | T | T | C | C | A |
|---|---|---|---|---|---|---|---|---|
| nogRNA-A1343spilt-KKH-Cas9-A1343-N and dSpCas9-A1343-C | A | 0.00% | 0.00% | 0.00% | 0.01% | 0.01% | 0.01% | 99.97% |
| nogRNA-A1343spilt-KKH-Cas9-A1343-N and dSpCas9-A1343-C | T | 0.01% | 0.00% | 99.96% | 99.98% | 0.00% | 0.01% | 0.00% |
| nogRNA-A1343spilt-KKH-Cas9-A1343-N and dSpCas9-A1343-C | C | 0.00% | 0.00% | 0.02% | 0.01% | 99.99% | 99.97% | 0.00% |
| nogRNA-A1343spilt-KKH-Cas9-A1343-N and dSpCas9-A1343-C | G | 99.99% | 99.99% | 0.02% | 0.00% | 0.00% | 0.00% | 0.02% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 0.00% | 0.00% | 0.00% | 0.01% | 0.00% | 99.89% |
| nogRNA-A1343spilt-KKH-Cas9-A1343-C and dSpCas9-A1343-N | T | 0.02% | 0.00% | 99.95% | 99.99% | 0.02% | 0.01% | 0.01% |
| nogRNA-A1343spilt-KKH-Cas9-A1343-C and dSpCas9-A1343-N | C | 0.00% | 0.00% | 0.03% | 0.00% | 99.97% | 99.97% | 0.06% |
| nogRNA-A1343spilt-KKH-Cas9-A1343-C and dSpCas9-A1343-N | G | 99.97% | 100.00% | 0.02% | 0.00% | 0.00% | 0.00% | 0.04% |

TABLE 10C-continued

| | | No gRNA | | | | | | |
|---|---|---|---|---|---|---|---|---|
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.01% | 0.00% |
| nogRNA-G1322spilt-KKH-Cas9-G1322-N and dSpCas9-G1322-C | A | 0.02% | 0.01% | 0.00% | 0.00% | 0.00% | 0.01% | 99.94% |
| nogRNA-G1322spilt-KKH-Cas9-G1322-N and dSpCas9-G1322-C | T | 0.00% | 0.00% | 99.96% | 99.98% | 0.01% | 0.02% | 0.01% |
| nogRNA-G1322spilt-KKH-Cas9-G1322-N and dSpCas9-G1322-C | C | 0.00% | 0.01% | 0.02% | 0.01% | 99.99% | 99.95% | 0.01% |
| nogRNA-G1322spilt-KKH-Cas9-G1322-N and dSpCas9-G1322-C | G | 99.98% | 99.98% | 0.02% | 0.00% | 0.00% | 0.00% | 0.03% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.01% | 0.00% |
| nogRNA-G1322spilt-KKH-Cas9-G1322-C and dSpCas9-G1322-N | A | 0.01% | 0.00% | 0.00% | 0.02% | 0.01% | 0.00% | 99.97% |
| nogRNA-G1322spilt-KKH-Cas9-G1322-C and dSpCas9-G1322-N | T | 0.01% | 0.00% | 99.95% | 99.97% | 0.05% | 0.02% | 0.01% |
| nogRNA-G1322spilt-KKH-Cas9-G1322-C and dSpCas9-G1322-N | C | 0.00% | 0.00% | 0.01% | 0.01% | 99.93% | 99.97% | 0.01% |
| nogRNA-G1322spilt-KKH-Cas9-G1322-C and dSpCas9-G1322-N | G | 99.97% | 99.99% | 0.03% | 0.00% | 0.00% | 0.00% | 0.02% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.01% | 0.00% |
| nogRNA-G1333spilt-KKH-Cas9-G1333-N and dSpCas9-G1333-C | A | 0.00% | 0.00% | 0.00% | 0.01% | 0.00% | 0.01% | 99.95% |
| nogRNA-G1333spilt-KKH-Cas9-G1333-N and dSpCas9-G1333-C | T | 0.00% | 0.00% | 99.96% | 99.94% | 0.03% | 0.00% | 0.00% |
| nogRNA-G1333spilt-KKH-Cas9-G1333-N and dSpCas9-G1333-C | C | 0.00% | 0.00% | 0.02% | 0.04% | 99.97% | 99.98% | 0.01% |
| nogRNA-G1333spilt-KKH-Cas9-G1333-N and dSpCas9-G1333-C | G | 10.000% | 100.00% | 0.02% | 0.00% | 0.00% | 0.00% | 0.04% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.01% | 0.00% | 0.00% | 0.00% | 0.00% | 99.96% |
| nogRNA-G1333spilt-KKH-Cas9-G1333-C and dSpCas9-G1333-N | T | 0.01% | 0.00% | 99.96% | 99.98% | 0.02% | 0.03% | 0.00% |
| nogRNA-G1333spilt-KKH-Cas9-G1333-C and dSpCas9-G1333-N | C | 0.00% | 0.00% | 0.02% | 0.01% | 99.98% | 99.95% | 0.02% |
| nogRNA-G1333spilt-KKH-Cas9-G1333-C and dSpCas9-G1333-N | G | 99.99% | 99.99% | 0.02% | 0.00% | 0.00% | 0.00% | 0.01% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.01% | 0.00% |

TABLE 10C-continued

| | | No gRNA | | | | | | |
|---|---|---|---|---|---|---|---|---|
| nogRNA-G1371spilt-KKH-Cas9-G1371-N and dSpCas9-G1371-C | A | 0.00% | 0.01% | 0.02% | 0.01% | 0.00% | 0.01% | 99.93% |
| nogRNA-G1371spilt-KKH-Cas9-G1371-N and dSpCas9-G1371-C | T | 0.02% | 0.00% | 99.95% | 99.98% | 0.02% | 0.01% | 0.02% |
| nogRNA-G1371spilt-KKH-Cas9-G1371-N and dSpCas9-G1371-C | C | 0.00% | 0.00% | 0.02% | 0.01% | 99.98% | 99.97% | 0.01% |
| nogRNA-G1371spilt-KKH-Cas9-G1371-N and dSpCas9-G1371-C | G | 99.98% | 99.98% | 0.02% | 0.00% | 0.00% | 0.00% | 0.03% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.01% | 0.00% |
| nogRNA-G1371spilt-KKH-Cas9-G1371-C and dSpCas9-G1371-N | A | 0.00% | 0.02% | 0.00% | 0.01% | 0.00% | 0.01% | 99.92% |
| nogRNA-G1371spilt-KKH-Cas9-G1371-C and dSpCas9-G1371-N | T | 0.00% | 0.00% | 99.96% | 99.96% | 0.02% | 0.03% | 0.01% |
| nogRNA-G1371spilt-KKH-Cas9-G1371-C and dSpCas9-G1371-N | C | 0.00% | 0.00% | 0.01% | 0.02% | 99.97% | 99.95% | 0.02% |
| nogRNA-G1371spilt-KKH-Cas9-G1371-C and dSpCas9-G1371-N | G | 99.99% | 99.98% | 0.02% | 0.00% | 0.00% | 0.00% | 0.06% |
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.01% | 0.00% | 0.01% | 0.00% |
| nogRNA-G1397spilt-KKH-Cas9-G1397-N and dSpCas9-G1397-C | A | 0.00% | 0.01% | 0.01% | 0.00% | 0.01% | 0.02% | 99.94% |
| nogRNA-G1397spilt-KKH-Cas9-G1397-N and dSpCas9-G1397-C | T | 0.00% | 0.00% | 99.95% | 99.96% | 0.01% | 0.02% | 0.01% |
| nogRNA-G1397spilt-KKH-Cas9-G1397-N and dSpCas9-G1397-C | C | 0.00% | 0.00% | 0.02% | 0.03% | 99.98% | 99.95% | 0.00% |
| nogRNA-G1397spilt-KKH-Cas9-G1397-N and dSpCas9-G1397-C | G | 99.95% | 99.94% | 0.01% | 0.00% | 0.00% | 0.00% | 0.04% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.05% | 0.05% | 0.00% | 0.00% | 0.00% | 0.01% | 0.00% |
| nogRNA-G1397spilt-KKH-Cas9-G1397-C and dSpCas9-G1397-N | A | 0.00% | 0.01% | 0.00% | 0.01% | 0.01% | 0.01% | 99.95% |
| nogRNA-G1397spilt-KKH-Cas9-G1397-C and dSpCas9-G1397-N | T | 0.01% | 0.00% | 99.95% | 99.96% | 0.02% | 0.01% | 0.01% |
| nogRNA-G1397spilt-KKH-Cas9-G1397-C and dSpCas9-G1397-N | C | 0.00% | 0.00% | 0.03% | 0.02% | 99.97% | 99.94% | 0.00% |
| nogRNA-G1397spilt-KKH-Cas9-G1397-C and dSpCas9-G1397-N | G | 99.99% | 99.99% | 0.02% | 0.01% | 0.00% | 0.01% | 0.03% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.02% | 0.00% |
| nogRNA-N1357spilt-KKH-Cas9-N1357-N and dSpCas9-N1357-C | A | 0.01% | 0.01% | 0.01% | 0.01% | 0.00% | 0.00% | 99.97% |
| nogRNA-N1357spilt-KKH-Cas9-N1357-N and dSpCas9-N1357-C | T | 0.01% | 0.00% | 99.97% | 99.97% | 0.01% | 0.01% | 0.01% |

TABLE 10C-continued

| | | | | | No gRNA | | | |
|---|---|---|---|---|---|---|---|---|
| nogRNA-N1357spilt-KKH-Cas9-N1357-N and dSpCas9-N1357-C | C | 0.00% | 0.00% | 0.00% | 0.02% | 99.98% | 99.98% | 0.00% |
| nogRNA-N1357spilt-KKH-Cas9-N1357-N and dSpCas9-N1357-C | G | 99.98% | 99.98% | 0.02% | 0.00% | 0.00% | 0.00% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.00% | 0.02% | 0.00% | 0.01% | 0.00% | 0.01% | 99.91% |
| nogRNA-N1357spilt-KKH-Cas9-N1357-C and dSpCas9-N1357-N | T | 0.02% | 0.00% | 99.97% | 99.97% | 0.02% | 0.02% | 0.01% |
| nogRNA-N1357spilt-KKH-Cas9-N1357-C and dSpCas9-N1357-N | C | 0.00% | 0.00% | 0.02% | 0.02% | 99.98% | 99.97% | 0.06% |
| nogRNA-N1357spilt-KKH-Cas9-N1357-C and dSpCas9-N1357-N | G | 99.98% | 99.98% | 0.02% | 0.00% | 0.00% | 0.00% | 0.03% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.01% | 0.00% | 0.01% | 0.00% | 0.01% | 0.00% |
| nogRNA-N1387spilt-KKH-Cas9-N1387-N and dSpCas9-N1387-C | A | 0.01% | 0.00% | 0.01% | 0.01% | 0.00% | 0.04% | 99.95% |
| nogRNA-N1387spilt-KKH-Cas9-N1387-N and dSpCas9-N1387-C | T | 0.00% | 0.01% | 99.96% | 99.95% | 0.01% | 0.01% | 0.00% |
| nogRNA-N1387spilt-KKH-Cas9-N1387-N and dSpCas9-N1387-C | C | 0.00% | 0.01% | 0.01% | 0.01% | 99.98% | 99.94% | 0.00% |
| nogRNA-N1387spilt-KKH-Cas9-N1387-N and dSpCas9-N1387-C | G | 99.97% | 99.96% | 0.01% | 0.01% | 0.00% | 0.00% | 0.04% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.01% | 0.01% | 0.01% | 0.01% | 0.01% | 0.00% |
| nogRNA-N1387spilt-KKH-Cas9-N1387-C and dSpCas9-N1387-N | A | 0.01% | 0.00% | 0.00% | 0.00% | 0.00% | 0.00% | 99.97% |
| nogRNA-N1387spilt-KKH-Cas9-N1387-C and dSpCas9-N1387-N | T | 0.01% | 0.01% | 99.97% | 99.96% | 0.02% | 0.01% | 0.00% |
| nogRNA-N1387spilt-KKH-Cas9-N1387-C and dSpCas9-N1387-N | C | 0.00% | 0.00% | 0.01% | 0.03% | 99.97% | 99.97% | 0.00% |
| nogRNA-N1387spilt-KKH-Cas9-N1387-C and dSpCas9-N1387-N | G | 99.98% | 99.99% | 0.02% | 0.00% | 0.00% | 0.00% | 0.03% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.01% | 0.00% |

| Batch | Nucleotide | G | A | A | C | C | G | G | A | G |
|---|---|---|---|---|---|---|---|---|---|---|
| nogRNA-A1343spilt-KKH-Cas9-A1343-N and dSpCas9-A1343-C | A | 0.00% | 99.98% | 99.96% | 0.01% | 0.00% | 0.00% | 0.01% | 99.92% | 0.00% |
| nogRNA-A1343spilt-KKH-Cas9-A1343-N and dSpCas9-A1343-C | T | 0.01% | 0.00% | 0.00% | 0.01% | 0.03% | 0.01% | 0.00% | 0.01% | 0.02% |
| nogRNA-A1343spilt-KKH-Cas9-A1343-N and dSpCas9-A1343-C | C | 0.00% | 0.01% | 0.02% | 99.98% | 99.96% | 0.00% | 0.00% | 0.01% | 0.00% |

TABLE 10C-continued

| | | No gRNA | | | | | | | | |
|---|---|---|---|---|---|---|---|---|---|---|
| nogRNA-A1343spilt-KKH-Cas9-A1343-N and dSpCas9-A1343-C | G | 99.98% | 0.00% | 0.02% | 0.00% | 0.00% | 99.98% | 99.98% | 0.05% | 99.98% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.02% | 99.91% | 99.92% | 0.00% | 0.00% | 0.01% | 0.00% | 99.83% | 0.00% |
| nogRNA-A1343spilt-KKH-Cas9-A1343-C and dSpCas9-A1343-N | T | 0.00% | 0.00% | 0.00% | 0.00% | 0.01% | 0.02% | 0.01% | 0.00% | 0.00% |
| nogRNA-A1343spilt-KKH-Cas9-A1343-C and dSpCas9-A1343-N | C | 0.00% | 0.07% | 0.06% | 99.99% | 99.98% | 0.01% | 0.00% | 0.08% | 0.00% |
| nogRNA-A1343spilt-KKH-Cas9-A1343-C and dSpCas9-A1343-N | G | 99.98% | 0.02% | 0.01% | 0.00% | 0.01% | 99.96% | 99.98% | 0.09% | 99.99% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.00% | 99.96% | 99.98% | 0.01% | 0.00% | 0.01% | 0.01% | 99.90% | 0.00% |
| nogRNA-G1322spilt-KKH-Cas9-G1322-N and dSpCas9-G1322-C | T | 0.00% | 0.00% | 0.00% | 0.01% | 0.02% | 0.00% | 0.01% | 0.02% | 0.02% |
| nogRNA-G1322spilt-KKH-Cas9-G1322-N and dSpCas9-G1322-C | C | 0.00% | 0.02% | 0.01% | 99.99% | 99.98% | 0.00% | 0.00% | 0.02% | 0.00% |
| nogRNA-G1322spilt-KKH-Cas9-G1322-N and dSpCas9-G1322-C | G | 99.99% | 0.01% | 0.01% | 0.00% | 0.01% | 99.98% | 99.98% | 0.06% | 99.98% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.01% | 99.97% | 99.96% | 0.00% | 0.01% | 0.03% | 0.01% | 99.92% | 0.00% |
| nogRNA-G1322spilt-KKH-Cas9-G1322-C and dSpCas9-G1322-N | T | 0.00% | 0.00% | 0.01% | 0.00% | 0.03% | 0.01% | 0.01% | 0.02% | 0.01% |
| nogRNA-G1322spilt-KKH-Cas9-G1322-C and dSpCas9-G1322-N | C | 0.00% | 0.00% | 0.00% | 99.99% | 99.95% | 0.00% | 0.00% | 0.02% | 0.00% |
| nogRNA-G1322spilt-KKH-Cas9-G1322-C and dSpCas9-G1322-N | G | 99.98% | 0.02% | 0.02% | 0.00% | 0.01% | 99.96% | 99.97% | 0.05% | 99.98% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 99.96% | 99.98% | 0.00% | 0.00% | 0.02% | 0.02% | 99.88% | 0.01% |
| nogRNA-G1333spilt-KKH-Cas9-G1333-N and dSpCas9-G1333-C | T | 0.00% | 0.00% | 0.00% | 0.01% | 0.00% | 0.01% | 0.00% | 0.02% | 0.01% |
| nogRNA-G1333spilt-KKH-Cas9-G1333-N and dSpCas9-G1333-C | C | 0.00% | 0.03% | 0.00% | 99.98% | 99.99% | 0.00% | 0.00% | 0.04% | 0.00% |
| nogRNA-G1333spilt-KKH-Cas9-G1333-N and dSpCas9-G1333-C | G | 100.00% | 0.01% | 0.00% | 0.00% | 0.01% | 99.97% | 99.98% | 0.06% | 99.98% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |

TABLE 10C-continued

| No gRNA | | | | | | | | | | |
|---|---|---|---|---|---|---|---|---|---|---|
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 99.96% | 99.97% | 0.00% | 0.00% | 0.02% | 0.01% | 99.90% | 0.02% |
| nogRNA-G1333spilt-KKH-Cas9-G1333-C and dSpCas9-G1333-N | T | 0.01% | 0.00% | 0.00% | 0.00% | 0.00% | 0.03% | 0.01% | 0.02% | 0.02% |
| nogRNA-G1333spilt-KKH-Cas9-G1333-C and dSpCas9-G1333-N | C | 0.00% | 0.02% | 0.01% | 99.99% | 100.00% | 0.00% | 0.00% | 0.03% | 0.00% |
| nogRNA-G1333spilt-KKH-Cas9-G1333-C and dSpCas9-G1333-N | G | 99.99% | 0.02% | 0.02% | 0.00% | 0.00% | 99.95% | 99.97% | 0.05% | 99.96% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.01% | 99.94% | 99.97% | 0.00% | 0.00% | 0.01% | 0.01% | 99.87% | 0.00% |
| nogRNA-G1371spilt-KKH-Cas9-G1371-N and dSpCas9-G1371-C | T | 0.01% | 0.00% | 0.01% | 0.00% | 0.02% | 0.01% | 0.00% | 0.00% | 0.01% |
| nogRNA-G1371spilt-KKH-Cas9-G1371-N and dSpCas9-G1371-C | C | 0.00% | 0.02% | 0.01% | 99.99% | 99.98% | 0.00% | 0.00% | 0.05% | 0.00% |
| nogRNA-G1371spilt-KKH-Cas9-G1371-N and dSpCas9-G1371-C | G | 99.98% | 0.04% | 0.02% | 0.00% | 0.00% | 99.98% | 99.98% | 0.07% | 99.98% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.01% | 0.01% | 0.00% |
| nogRNA-G1371spilt-KKH-Cas9-G1371-C and dSpCas9-G1371-N | A | 0.01% | 99.96% | 99.96% | 0.00% | 0.00% | 0.00% | 0.01% | 99.88% | 0.01% |
| nogRNA-G1371spilt-KKH-Cas9-G1371-C and dSpCas9-G1371-N | T | 0.01% | 0.00% | 0.01% | 0.01% | 0.02% | 0.01% | 0.00% | 0.01% | 0.01% |
| nogRNA-G1371spilt-KKH-Cas9-G1371-C and dSpCas9-G1371-N | C | 0.00% | 0.01% | 0.01% | 99.98% | 99.98% | 0.00% | 0.00% | 0.04% | 0.00% |
| nogRNA-G1371spilt-KKH-Cas9-G1371-C and dSpCas9-G1371-N | G | 99.98% | 0.03% | 0.01% | 0.00% | 0.00% | 99.99% | 99.98% | 0.07% | 99.98% |
| nogRNA-G1371spilt-KKH-Cas9-G1371-C and dSnCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.00% | 99.98% | 99.98% | 0.00% | 0.00% | 0.02% | 0.01% | 99.92% | 0.01% |
| nogRNA-G1397spilt-KKH-Cas9-G1397-N and dSpCas9-G1397-C | T | 0.00% | 0.00% | 0.00% | 0.00% | 0.03% | 0.02% | 0.01% | 0.02% | 0.00% |
| nogRNA-G1397spilt-KKH-Cas9-G1397-N and dSpCas9-G1397-C | C | 0.00% | 0.01% | 0.01% | 100.00% | 99.95% | 0.01% | 0.00% | 0.02% | 0.00% |
| nogRNA-G1397spilt-KKH-Cas9-G1397-N and dSpCas9-G1397-C | G | 99.99% | 0.01% | 0.00% | 0.00% | 0.01% | 99.95% | 99.98% | 0.03% | 99.99% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | A | 0.01% | 99.98% | 99.96% | 0.00% | 0.01% | 0.01% | 0.01% | 99.91% | 0.00% |

TABLE 10C-continued

| No gRNA | | | | | | | | | | |
|---|---|---|---|---|---|---|---|---|---|---|
| nogRNA-G1397spilt-KKH-Cas9-G1397-C and dSpCas9-G1397-N | T | 0.01% | 0.00% | 0.01% | 0.00% | 0.02% | 0.01% | 0.01% | 0.02% | 0.01% |
| nogRNA-G1397spilt-KKH-Cas9-G1397-C and dSpCas9-G1397-N | C | 0.00% | 0.01% | 0.01% | 99.99% | 99.95% | 0.00% | 0.00% | 0.01% | 0.00% |
| nogRNA-G1397spilt-KKH-Cas9-G1397-C and dSpCas9-G1397-N | G | 99.97% | 0.01% | 0.02% | 0.00% | 0.01% | 99.98% | 99.98% | 0.06% | 99.99% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.01% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | A | 0.01% | 99.97% | 99.96% | 0.00% | 0.00% | 0.02% | 0.01% | 99.93% | 0.01% |
| nogRNA-N1357spilt-KKH-Cas9-N1357-N and dSpCas9-N1357-C | T | 0.00% | 0.01% | 0.01% | 0.00% | 0.01% | 0.01% | 0.01% | 0.02% | 0.00% |
| nogRNA-N1357spilt-KKH-Cas9-N1357-N and dSpCas9-N1357-C | C | 0.00% | 0.01% | 0.02% | 100.00% | 99.98% | 0.00% | 0.00% | 0.03% | 0.00% |
| nogRNA-N1357spilt-KKH-Cas9-N1357-N and dSpCas9-N1357-C | G | 99.98% | 0.01% | 0.02% | 0.00% | 0.00% | 99.97% | 99.98% | 0.03% | 99.98% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.01% | 99.90% | 99.94% | 0.00% | 0.00% | 0.01% | 0.01% | 99.85% | 0.01% |
| nogRNA-N1357spilt-KKH-Cas9-N1357-C and dSpCas9-N1357-N | T | 0.01% | 0.00% | 0.00% | 0.01% | 0.02% | 0.03% | 0.01% | 0.01% | 0.01% |
| nogRNA-N1357spilt-KKH-Cas9-N1357-C and dSpCas9-N1357-N | C | 0.00% | 0.05% | 0.06% | 99.98% | 99.98% | 0.01% | 0.01% | 0.07% | 0.00% |
| nogRNA-N1357spilt-KKH-Cas9-N1357-C and dSpCas9-N1357-N | G | 99.98% | 0.05% | 0.01% | 0.01% | 0.00% | 99.95% | 99.97% | 0.08% | 99.99% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.01% | 0.01% | 0.00% | 0.00% |
| nogRNA-N1387spilt-KKH-Cas9-N1387-N and dSpCas9-N1387-C | A | 0.01% | 99.97% | 99.96% | 0.01% | 0.00% | 0.01% | 0.02% | 99.85% | 0.00% |
| nogRNA-N1387spilt-KKH-Cas9-N1387-N and dSpCas9-N1387-C | T | 0.01% | 0.00% | 0.00% | 0.01% | 0.01% | 0.01% | 0.00% | 0.03% | 0.01% |
| nogRNA-N1387spilt-KKH-Cas9-N1387-N and dSpCas9-N1387-C | C | 0.00% | 0.01% | 0.01% | 99.98% | 99.96% | 0.00% | 0.00% | 0.03% | 0.00% |
| nogRNA-N1387spilt-KKH-Cas9-N1387-N and dSpCas9-N1387-C | G | 99.98% | 0.01% | 0.03% | 0.00% | 0.02% | 99.97% | 99.97% | 0.09% | 99.98% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.00% | 99.99% | 99.98% | 0.00% | 0.00% | 0.00% | 0.02% | 99.92% | 0.01% |
| nogRNA-N1387spilt-KKH-Cas9-N1387-C and dSpCas9-N1387-N | T | 0.00% | 0.00% | 0.00% | 0.00% | 0.01% | 0.01% | 0.01% | 0.01% | 0.01% |
| nogRNA-N1387spilt-KKH-Cas9-N1387-C and dSpCas9-N1387-N | C | 0.00% | 0.01% | 0.01% | 100.00% | 99.98% | 0.00% | 0.00% | 0.02% | 0.00% |

TABLE 10C-continued

| No gRNA | | | | | | | | | | |
|---|---|---|---|---|---|---|---|---|---|---|
| nogRNA-N1387spilt-KKH-Cas9-N1387-C and dSpCas9-N1387-N | G | 99.99% | 0.00% | 0.01% | 0.00% | 0.00% | 99.99% | 99.97% | 0.04% | 99.98% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% | 0.00% |

| Batch | Nucleotide | G | A | C | A | A | A | G | T |
|---|---|---|---|---|---|---|---|---|---|
| nogRNA-A1343spilt-KKH-Cas9-A1343-N and dSpCas9-A1343-C | A | 0.00% | 99.92% | 0.00% | 99.92% | 99.92% | 99.89% | 0.00% | 0.07% |
| nogRNA-A1343spilt-KKH-Cas9-A1343-N and dSpCas9-A1343-C | T | 0.01% | 0.02% | 0.00% | 0.01% | 0.01% | 0.00% | 0.02% | 99.86% |
| nogRNA-A1343spilt-KKH-Cas9-A1343-N and dSpCas9-A1343-C | C | 0.01% | 0.04% | 99.99% | 0.04% | 0.05% | 0.06% | 0.00% | 0.03% |
| nogRNA-A1343spilt-KKH-Cas9-A1343-N and dSpCas9-A1343-C | G | 99.98% | 0.02% | 0.00% | 0.03% | 0.02% | 0.04% | 99.98% | 0.04% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 99.83% | 0.00% | 99.87% | 99.86% | 99.88% | 0.00% | 0.08% |
| nogRNA-A1343spilt-KKH-Cas9-A1343-C and dSpCas9-A1343-N | T | 0.02% | 0.02% | 0.01% | 0.02% | 0.01% | 0.01% | 0.01% | 99.81% |
| nogRNA-A1343spilt-KKH-Cas9-A1343-C and dSpCas9-A1343-N | C | 0.01% | 0.09% | 99.99% | 0.08% | 0.0% | 0.07% | 0.00% | 0.07% |
| nogRNA-A1343spilt-KKH-Cas9-A1343-C and dSpCas9-A1343-N | G | 99.97% | 0.05% | 0.00% | 0.03% | 0.02% | 0.04% | 99.98% | 0.04% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.02% | 99.89% | 0.00% | 99.94% | 99.94% | 99.94% | 0.00% | 0.07% |
| nogRNA-G1322spilt-KKH-Cas9-G1322-N and dSpCas9-G1322-C | T | 0.00% | 0.01% | 0.01% | 0.01% | 0.01% | 0.00% | 0.00% | 99.83% |
| nogRNA-G1322spilt-KKH-Cas9-G1322-N and dSpCas9-G1322-C | C | 0.00% | 0.05% | 99.99% | 0.01% | 0.05% | 0.03% | 0.00% | 0.05% |
| nogRNA-G1322spilt-KKH-Cas9-G1322-N and dSpCas9-G1322-C | G | 99.98% | 0.05% | 0.00% | 0.04% | 0.01% | 0.02% | 100.00% | 0.04% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.01% | 0.00% | 0.00% |
| nogRNA-G1322spilt-KKH-Cas9-G1322-C and dSpCas9-G1322-N | A | 0.01% | 99.85% | 0.01% | 99.94% | 99.93% | 99.89% | 0.01% | 0.08% |
| nogRNA-G1322spilt-KKH-Cas9-G1322-C and dSpCas9-G1322-N | T | 0.00% | 0.02% | 0.01% | 0.01% | 0.01% | 0.01% | 0.00% | 99.82% |
| nogRNA-G1322spilt-KKH-Cas9-G1322-C and dSpCas9-G1322-N | C | 0.00% | 0.06% | 99.97% | 0.02% | 0.03% | 0.04% | 0.00% | 0.03% |
| nogRNA-G1322spilt-KKH-Cas9-G1322-C and dSpCas9-G1322-N | G | 99.98% | 0.06% | 0.00% | 0.03% | 0.03% | 0.05% | 99.99% | 0.07% |

TABLE 10C-continued

| No gRNA | | | | | | | | | |
|---|---|---|---|---|---|---|---|---|---|
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.01% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 99.88% | 0.00% | 99.94% | 99.94% | 99.91% | 0.00% | 0.08% |
| nogRNA-G1333spilt-KKH-Cas9-G1333-N and dSpCas9-G1333-C | T | 0.00% | 0.01% | 0.03% | 0.00% | 0.01% | 0.00% | 0.01% | 99.81% |
| nogRNA-G1333spilt-KKH-Cas9-G1333-N and dSpCas9-G1333-C | C | 0.00% | 0.04% | 99.97% | 0.05% | 0.05% | 0.03% | 0.00% | 0.05% |
| nogRNA-G1333spilt-KKH-Cas9-G1333-N and dSpCas9-G1333-C | G | 100.00% | 0.06% | 0.00% | 0.00% | 0.00% | 0.06% | 99.99% | 0.06% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.03% | 99.89% | 0.00% | 99.94% | 99.93% | 99.90% | 0.00% | 0.09% |
| nogRNA-G1333spilt-KKH-Cas9-G1333-C and dSpCas9-G1333-N | T | 0.00% | 0.00% | 0.00% | 0.01% | 0.01% | 0.02% | 0.01% | 99.80% |
| nogRNA-G1333spilt-KKH-Cas9-G1333-C and dSpCas9-G1333-N | C | 0.00% | 0.07% | 100.00% | 0.02% | 0.05% | 0.05% | 0.00% | 0.06% |
| nogRNA-G1333spilt-KKH-Cas9-G1333-C and dSpCas9-G1333-N | G | 99.96% | 0.03% | 0.00% | 0.03% | 0.01% | 0.03% | 99.99% | 0.05% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.00% | 99.87% | 0.01% | 99.95% | 99.91% | 99.93% | 0.01% | 0.09% |
| nogRNA-G1371spilt-KKH-Cas9-G1371-N and dSpCas9-G1371-C | T | 0.02% | 0.03% | 0.02% | 0.02% | 0.00% | 0.00% | 0.01% | 99.79% |
| nogRNA-G1371spilt-KKH-Cas9-G1371-N and dSpCas9-G1371-C | C | 0.00% | 0.06% | 99.98% | 0.01% | 0.07% | 0.02% | 0.00% | 0.05% |
| nogRNA-G1371spilt-KKH-Cas9-G1371-N and dSpCas9-G1371-C | G | 99.98% | 0.03% | 0.00% | 0.02% | 0.02% | 0.05% | 99.98% | 0.07% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | A | 0.01% | 99.86% | 0.01% | 99.96% | 99.93% | 99.92% | 0.00% | 0.06% |
| nogRNA-G1371spilt-KKH-Cas9-G1371-C and dSpCas9-G1371-N | T | 0.01% | 0.02% | 0.02% | 0.01% | 0.01% | 0.01% | 0.01% | 99.85% |
| nogRNA-G1371spilt-KKH-Cas9-G1371-C and dSpCas9-G1371-N | C | 0.00% | 0.05% | 99.97% | 0.02% | 0.05% | 0.04% | 0.00% | 0.04% |
| nogRNA-G1371spilt-KKH-Cas9-G1371-C and dSpCas9-G1371-N | G | 99.98% | 0.07% | 0.00% | 0.02% | 0.01% | 0.03% | 99.99% | 0.05% |
| nogRNA-G1371spilt-KKH-Cas9-G1371-C and dSnCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% |

TABLE 10C-continued

| No gRNA | | | | | | | | | |
|---|---|---|---|---|---|---|---|---|---|
| nogRNA-G1397spilt-KKH-Cas9-G1397-N and dSpCas9-G1397-C | A | 0.01% | 99.88% | 0.00% | 99.93% | 99.90% | 99.90% | 0.00% | 0.04% |
| nogRNA-G1397spilt-KKH-Cas9-G1397-N and dSpCas9-G1397-C | T | 0.00% | 0.01% | 0.02% | 0.01% | 0.02% | 0.00% | 0.00% | 99.88% |
| nogRNA-G1397spilt-KKH-Cas9-G1397-N and dSpCas9-G1397-C | C | 0.00% | 0.07% | 99.98% | 0.03% | 0.07% | 0.04% | 0.00% | 0.03% |
| nogRNA-G1397spilt-KKH-Cas9-G1397-N and dSpCas9-G1397-C | G | 99.99% | 0.04% | 0.00% | 0.02% | 0.01% | 0.05% | 99.99% | 0.05% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.01% | 0.00% | 0.00% |
| nogRNA-G1397spilt-KKH-Cas9-G1397-C and dSpCas9-G1397-N | A | 0.00% | 99.87% | 0.00% | 99.93% | 99.90% | 99.93% | 0.00% | 0.07% |
| nogRNA-G1397spilt-KKH-Cas9-G1397-C and dSpCas9-G1397-N | T | 0.00% | 0.01% | 0.04% | 0.01% | 0.00% | 0.00% | 0.00% | 99.83% |
| nogRNA-G1397spilt-KKH-Cas9-G1397-C and dSpCas9-G1397-N | C | 0.00% | 0.06% | 99.96% | 0.05% | 0.05% | 0.03% | 0.00% | 0.04% |
| nogRNA-G1397spilt-KKH-Cas9-G1397-C and dSpCas9-G1397-N | G | 99.99% | 0.06% | 0.00% | 0.01% | 0.04% | 0.03% | 99.99% | 0.06% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.01% | 0.00% | 0.00% | 0.00% | 0.01% | 0.01% | 0.00% |
| nogRNA-N1357spilt-KKH-Cas9-N1357-N and dSpCas9-N1357-C | A | 0.03% | 99.86% | 0.02% | 99.95% | 99.92% | 99.90% | 0.00% | 0.06% |
| nogRNA-N1357spilt-KKH-Cas9-N1357-N and dSpCas9-N1357-C | T | 0.00% | 0.03% | 0.01% | 0.00% | 0.01% | 0.01% | 0.00% | 99.83% |
| nogRNA-N1357spilt-KKH-Cas9-N1357-N and dSpCas9-N1357-C | C | 0.00% | 0.08% | 99.97% | 0.03% | 0.06% | 0.04% | 0.00% | 0.06% |
| nogRNA-N1357spilt-KKH-Cas9-N1357-N and dSpCas9-N1357-C | G | 99.97% | 0.03% | 0.00% | 0.02% | 0.01% | 0.03% | 100.00% | 0.04% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.01% | 0.00% | 0.00% |
| nogRNA-N1357spilt-KKH-Cas9-N1357-C and dSpCas9-N1357-N | A | 0.01% | 99.80% | 0.01% | 99.90% | 99.90% | 99.90% | 0.00% | 0.10% |
| nogRNA-N1357spilt-KKH-Cas9-N1357-C and dSpCas9-N1357-N | T | 0.04% | 0.03% | 0.01% | 0.00% | 0.01% | 0.01% | 0.01% | 99.80% |
| nogRNA-N1357spilt-KKH-Cas9-N1357-C and dSpCas9-N1357-N | C | 0.00% | 0.10% | 99.98% | 0.07% | 0.08% | 0.07% | 0.00% | 0.05% |
| nogRNA-N1357spilt-KKH-Cas9-N1357-C and dSpCas9-N1357-N | G | 99.95% | 0.07% | 0.00% | 0.03% | 0.01% | 0.02% | 99.99% | 0.05% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.01% | 0.00% | 0.00% |
| nogRNA-N1387spilt-KKH-Cas9-N1387-N and dSpCas9-N1387-C | A | 0.01% | 99.85% | 0.01% | 99.93% | 99.90% | 99.91% | 0.00% | 0.12% |
| nogRNA-N1387spilt-KKH-Cas9-N1387-N and dSpCas9-N1387-C | T | 0.01% | 0.02% | 0.01% | 0.00% | 0.03% | 0.01% | 0.00% | 99.81% |

TABLE 10C-continued

| | | | | | | | | | |
|---|---|---|---|---|---|---|---|---|---|
| No gRNA | | | | | | | | | |
| nogRNA-N1387spilt-KKH-Cas9-N1387-N and dSpCas9-N1387-C | C | 0.00% | 0.09% | 99.96 | 0.04% | 0.06% | 0.04% | 0.00% | 0.03% |
| nogRNA-N1387spilt-KKH-Cas9-N1387-N and dSpCas9-N1387-C | G | 99.97% | 0.03% | 0.00% | 0.02% | 0.01% | 0.04% | 99.99% | 0.04% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.01% | 99.86% | 0.01% | 99.91% | 99.95% | 99.91% | 0.00% | 0.07% |
| nogRNA-N1387spilt-KKH-Cas9-N1387-C and dSpCas9-N1387-N | T | 0.01% | 0.03% | 0.01% | 0.02% | 0.01% | 0.00% | 0.00% | 99.86% |
| nogRNA-N1387spilt-KKH-Cas9-N1387-C and dSpCas9-N1387-N | C | 0.00% | 0.04% | 99.97% | 0.04% | 0.03% | 0.04% | 0.00% | 0.04% |
| nogRNA-N1387spilt-KKH-Cas9-N1387-C and dSpCas9-N1387-N | G | 99.98% | 0.07% | 0.00% | 0.04% | 0.00% | 0.04% | 99.99% | 0.02% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% |

| Batch | Nucleotide | A | C | A | A | A | C | G |
|---|---|---|---|---|---|---|---|---|
| nogRNA-A1343spilt-KKH-Cas9-A1343-N and dSpCas9-A1343-C | A | 99.94% | 0.03% | 99.98% | 99.99% | 99.96% | 0.01% | 0.01% |
| nogRNA-A1343spilt-KKH-Cas9-A1343-N and dSpCas9-A1343-C | T | 0.02% | 0.01% | 0.00% | 0.00% | 0.00% | 0.00% | 0.01% |
| nogRNA-A1343spilt-KKH-Cas9-A1343-N and dSpCas9-A1343-C | C | 0.01% | 99.96% | 0.00% | 0.00% | 0.02% | 99.97% | 0.02% |
| nogRNA-A1343spilt-KKH-Cas9-A1343-N and dSpCas9-A1343-C | G | 0.02% | 0.00% | 0.02% | 0.00% | 0.01% | 0.02% | 99.97% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% |
| nogRNA-A1343spilt-KKH-Cas9-A1343-C and dSpCas9-A1343-N | A | 99.88% | 0.05% | 99.91% | 99.93% | 99.92% | 0.02% | 0.02% |
| nogRNA-A1343spilt-KKH-Cas9-A1343-C and dSpCas9-A1343-N | T | 0.00% | 0.03% | 0.00% | 0.00% | 0.00% | 0.02% | 0.01% |
| nogRNA-A1343spilt-KKH-Cas9-A1343-C and dSpCas9-A1343-N | C | 0.09% | 99.92% | 0.06% | 0.05% | 0.08% | 99.95% | 0.00% |
| nogRNA-A1343spilt-KKH-Cas9-A1343-C and dSpCas9-A1343-N | G | 0.03% | 0.00% | 0.02% | 0.01% | 0.00% | 0.01% | 99.96% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% |
| nogRNA-G1322spilt-KKH-Cas9-G1322-N and dSpCas9-G1322-C | A | 99.95% | 0.03% | 99.96% | 99.97% | 99.97% | 0.02% | 0.01% |
| nogRNA-G1322spilt-KKH-Cas9-G1322-N and dSpCas9-G1322-C | T | 0.01% | 0.02% | 0.00% | 0.00% | 0.00% | 0.01% | 0.01% |
| nogRNA-G1322spilt-KKH-Cas9-G1322-N and dSpCas9-G1322-C | C | 0.01% | 99.94% | 0.01% | 0.02% | 0.02% | 99.96% | 0.00% |

TABLE 10C-continued

| No gRNA | | | | | | | | |
|---|---|---|---|---|---|---|---|---|
| nogRNA-G1322spilt-KKH-Cas9-G1322-N and dSpCas9-G1322-C | G | 0.02% | 0.01% | 0.02% | 0.01% | 0.01% | 0.01% | 99.99% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% |
| nogRNA-G1322spilt-KKH-Cas9-G1322-C and dSpCas9-G1322-N | A | 99.97% | 0.01% | 99.97% | 99.97% | 99.97% | 0.02% | 0.01% |
| nogRNA-G1322spilt-KKH-Cas9-G1322-C and dSpCas9-G1322-N | T | 0.01% | 0.00% | 0.00% | 0.00% | 0.00% | 0.02% | 0.00% |
| nogRNA-G1322spilt-KKH-Cas9-G1322-C and dSpCas9-G1322-N | C | 0.01% | 99.99% | 0.02% | 0.02% | 0.02% | 99.95% | 0.00% |
| nogRNA-G1322spilt-KKH-Cas9-G1322-C and dSpCas9-G1322-N | G | 0.02% | 0.00% | 0.01% | 0.01% | 0.00% | 0.01% | 99.99% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% |
| nogRNA-G1333spilt-KKH-Cas9-G1333-N and dSpCas9-G1333-C | A | 99.95% | 0.03% | 99.97% | 99.98% | 100.00% | 0.03% | 0.04% |
| nogRNA-G1333spilt-KKH-Cas9-G1333-N and dSpCas9-G1333-C | T | 0.01% | 0.01% | 0.00% | 0.00% | 0.00% | 0.04% | 0.01% |
| nogRNA-G1333spilt-KKH-Cas9-G1333-N and dSpCas9-G1333-C | C | 0.02% | 99.96% | 0.01% | 0.00% | 0.00% | 99.92% | 0.00% |
| nogRNA-G1333spilt-KKH-Cas9-G1333-N and dSpCas9-G1333-C | G | 0.02% | 0.00% | 0.02% | 0.02% | 0.00% | 0.01% | 99.94% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% |
| nogRNA-G1333spilt-KKH-Cas9-G1333-C and dSpCas9-G1333-N | A | 99.98% | 0.00% | 99.96% | 99.96% | 99.97% | 0.01% | 0.01% |
| nogRNA-G1333spilt-KKH-Cas9-G1333-C and dSpCas9-G1333-N | T | 0.01% | 0.01% | 0.00% | 0.00% | 0.00% | 0.03% | 0.00% |
| nogRNA-G1333spilt-KKH-Cas9-G1333-C and dSpCas9-G1333-N | C | 0.00% | 99.97% | 0.02% | 0.02% | 0.01% | 99.96% | 0.00% |
| nogRNA-G1333spilt-KKH-Cas9-G1333-C and dSpCas9-G1333-N | G | 0.00% | 0.01% | 0.01% | 0.02% | 0.01% | 0.00% | 99.98% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% |
| nogRNA-G1371spilt-KKH-Cas9-G1371-N and dSpCas9-G1371-C | A | 99.97% | 0.02% | 99.97% | 99.97% | 99.95% | 0.02% | 0.02% |
| nogRNA-G1371spilt-KKH-Cas9-G1371-N and dSpCas9-G1371-C | T | 0.01% | 0.01% | 0.00% | 0.00% | 0.00% | 0.02% | 0.00% |
| nogRNA-G1371spilt-KKH-Cas9-G1371-N and dSpCas9-G1371-C | C | 0.01% | 99.97% | 0.02% | 0.02% | 0.03% | 99.96% | 0.01% |
| nogRNA-G1371spilt-KKH-Cas9-G1371-N and dSpCas9-G1371-C | G | 0.01% | 0.00% | 0.01% | 0.02% | 0.01% | 0.00% | 99.97% |
| nogRNA-G1371spilt-KKH-Cas9-G1371-N and dSpCas9-G1371-C | N | 0.00% | 0.00% | 0.00% | 0.00% | 0.00% | 0.00% | 0.00% |

TABLE 10C-continued

| No gRNA | | | | | | | | |
|---|---|---|---|---|---|---|---|---|
| nogRNA-G1371spilt-KKH-Cas9-G1371-N and dSpCas9-G1371-C | — | 0.00% | 0.00% | 0.00% | 0.00% | 0.00% | 0.00% | 0.00% |
| nogRNA-G1371spilt-KKH-Cas9-G1371-C and dSpCas9-G1371-N | A | 99.97% | 0.02% | 99.95% | 99.98% | 99.96% | 0.01% | 0.02% |
| nogRNA-G1371spilt-KKH-Cas9-G1371-C and dSpCas9-G1371-N | T | 0.01% | 0.01% | 0.00% | 0.01% | 0.00% | 0.02% | 0.01% |
| nogRNA-G1371spilt-KKH-Cas9-G1371-C and dSpCas9-G1371-N | C | 0.01% | 99.96% | 0.02% | 0.01% | 0.03% | 99.95% | 0.00% |
| nogRNA-G1371spilt-KKH-Cas9-G1371-C and dSpCas9-G1371-N | G | 0.01% | 0.00% | 0.02% | 0.01% | 0.00% | 0.01% | 99.97% |
| nogRNA-G1371spilt-KKH-Cas9-G1371-C and dSnCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% |
| nogRNA-G1397spilt-KKH-Cas9-G1397-N and dSpCas9-G1397-C | A | 99.95% | 0.00% | 99.99% | 99.97% | 99.95% | 0.02% | 0.02% |
| nogRNA-G1397spilt-KKH-Cas9-G1397-N and dSpCas9-G1397-C | T | 0.01% | 0.01% | 0.00% | 0.00% | 0.00% | 0.02% | 0.00% |
| nogRNA-G1397spilt-KKH-Cas9-G1397-N and dSpCas9-G1397-C | C | 0.02% | 99.99% | 0.00% | 0.00% | 0.02% | 99.95% | 0.00% |
| nogRNA-G1397spilt-KKH-Cas9-G1397-N and dSpCas9-G1397-C | G | 0.01% | 0.00% | 0.01% | 0.02% | 0.01% | 0.01% | 99.97% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% |
| nogRNA-G1397spilt-KKH-Cas9-G1397-C and dSpCas9-G1397-N | A | 99.96% | 0.02% | 99.98% | 99.93% | 99.97% | 0.01% | 0.02% |
| nogRNA-G1397spilt-KKH-Cas9-G1397-C and dSpCas9-G1397-N | T | 0.01% | 0.01% | 0.00% | 0.01% | 0.00% | 0.03% | 0.00% |
| nogRNA-G1397spilt-KKH-Cas9-G1397-C and dSpCas9-G1397-N | C | 0.00% | 99.96% | 0.01% | 0.03% | 0.02% | 99.95% | 0.00% |
| nogRNA-G1397spilt-KKH-Cas9-G1397-C and dSpCas9-G1397-N | G | 0.03% | 0.01% | 0.01% | 0.03% | 0.01% | 0.00% | 99.98% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.01% | 0.00% |
| nogRNA-N1357spilt-KKH-Cas9-N1357-N and dSpCas9-N1357-C | A | 99.94% | 0.00% | 99.99% | 99.98% | 99.98% | 0.00% | 0.01% |
| nogRNA-N1357spilt-KKH-Cas9-N1357-N and dSpCas9-N1357-C | T | 0.02% | 0.01% | 0.00% | 0.01% | 0.00% | 0.01% | 0.00% |
| nogRNA-N1357spilt-KKH-Cas9-N1357-N and dSpCas9-N1357-C | C | 0.02% | 99.98% | 0.00% | 0.00% | 0.02% | 99.98% | 0.00% |
| nogRNA-N1357spilt-KKH-Cas9-N1357-N and dSpCas9-N1357-C | G | 0.03% | 0.00% | 0.00% | 0.01% | 0.00% | 0.00% | 99.99% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% |
| nogRNA-N1357spilt-KKH-Cas9-N1357-C and dSpCas9-N1357-N | A | 99.93% | 0.04% | 99.94% | 99.92% | 99.93% | 0.01% | 0.02% |

TABLE 10C-continued

| | | No gRNA | | | | | | |
|---|---|---|---|---|---|---|---|---|
| nogRNA-N1357spilt-KKH-Cas9-N1357-C and dSpCas9-N1357-N | T | 0.00% | 0.02% | 0.00% | 0.00% | 0.00% | 0.02% | 0.00% |
| nogRNA-N1357spilt-KKH-Cas9-N1357-C and dSpCas9-N1357-N | C | 0.05% | 99.94% | 0.04% | 0.05% | 0.05% | 99.96% | 0.01% |
| nogRNA-N1357spilt-KKH-Cas9-N1357-C and dSpCas9-N1357-N | G | 0.02% | 0.00% | 0.01% | 0.03% | 0.02% | 0.02% | 99.97% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% |
| nogRNA-N1387spilt-KKH-Cas9-N1387-N and dSpCas9-N1387-C | A | 99.96% | 0.03% | 99.97% | 99.96% | 99.98% | 0.01% | 0.02% |
| nogRNA-N1387spilt-KKH-Cas9-N1387-N and dSpCas9-N1387-C | T | 0.00% | 0.00% | 0.00% | 0.00% | 0.00% | 0.01% | 0.00% |
| nogRNA-N1387spilt-KKH-Cas9-N1387-N and dSpCas9-N1387-C | C | 0.02% | 99.96% | 0.01% | 0.01% | 0.01% | 99.97% | 0.00% |
| nogRNA-N1387spilt-KKH-Cas9-N1387-N and dSpCas9-N1387-C | G | 0.01% | 0.00% | 0.01% | 0.02% | 0.00% | 0.01% | 99.97% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.01% | 0.00% | 0.00% | 0.00% | 0.00% | 0.00% |
| nogRNA-N1387spilt-KKH-Cas9-N1387-C and dSpCas9-N1387-N | A | 99.96% | 0.02% | 99.98% | 99.98% | 99.97% | 0.01% | 0.01% |
| nogRNA-N1387spilt-KKH-Cas9-N1387-C and dSpCas9-N1387-N | T | 0.01% | 0.02% | 0.00% | 0.00% | 0.00% | 0.04% | 0.00% |
| nogRNA-N1387spilt-KKH-Cas9-N1387-C and dSpCas9-N1387-N | C | 0.00% | 99.96% | 0.01% | 0.01% | 0.02% | 99.95% | 0.01% |
| nogRNA-N1387spilt-KKH-Cas9-N1387-C and dSpCas9-N1387-N | G | 0.02% | 0.00% | 0.00% | 0.00% | 0.01% | 0.01% | 99.98% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% |

| Batch | Nucleotide | G | C | A | G | A | A | G | C | T |
|---|---|---|---|---|---|---|---|---|---|---|
| nogRNA-A1343spilt-KKH-Cas9-A1343-N and dSpCas9-A1343-C | A | 0.01% | 0.01% | 99.93% | 0.00% | 99.94% | 99.92% | 0.00% | 0.00% | 0.00% |
| nogRNA-A1343spilt-KKH-Cas9-A1343-N and dSpCas9-A1343-C | T | 0.02% | 0.02% | 0.00% | 0.00% | 0.01% | 0.00% | 0.00% | 0.01% | 99.95% |
| nogRNA-A1343spilt-KKH-Cas9-A1343-N and dSpCas9-A1343-C | C | 0.00% | 99.96% | 0.00% | 0.00% | 0.01% | 0.02% | 0.00% | 99.98% | 0.02% |
| nogRNA-A1343spilt-KKH-Cas9-A1343-N and dSpCas9-A1343-C | G | 99.98% | 0.01% | 0.07% | 99.99% | 0.04% | 0.06% | 99.98% | 0.00% | 0.02% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.02% | 0.02% | 99.82% | 0.01% | 99.91% | 99.83% | 0.00% | 0.00% | 0.00% |
| nogRNA-A1343spilt-KKH-Cas9-A1343-C and dSpCas9-A1343-N | T | 0.00% | 0.01% | 0.01% | 0.00% | 0.00% | 0.01% | 0.00% | 0.00% | 99.94% |

TABLE 10C-continued

| No gRNA | | | | | | | | | | |
|---|---|---|---|---|---|---|---|---|---|---|
| nogRNA-A1343spilt-KKH-Cas9-A1343-C and dSpCas9-A1343-N | C | 0.00% | 99.94% | 0.08% | 0.00% | 0.07% | 0.08% | 0.00% | 99.98% | 0.01% |
| nogRNA-A1343spilt-KKH-Cas9-A1343-C and dSpCas9-A1343-N | G | 99.97% | 0.03% | 0.09% | 99.98% | 0.02% | 0.08% | 99.99% | 0.01% | 0.05% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | A | 0.03% | 0.01% | 99.93% | 0.01% | 99.96% | 99.93% | 0.00% | 0.00% | 0.00% |
| nogRNA-G1322spilt-KKH-Cas9-G1322-N and dSpCas9-G1322-C | T | 0.01% | 0.01% | 0.00% | 0.01% | 0.00% | 0.01% | 0.00% | 0.01% | 99.96% |
| nogRNA-G1322spilt-KKH-Cas9-G1322-N and dSpCas9-G1322-C | C | 0.01% | 99.96% | 0.01% | 0.00% | 0.03% | 0.02% | 0.00% | 99.98% | 0.02% |
| nogRNA-G1322spilt-KKH-Cas9-G1322-N and dSpCas9-G1322-C | G | 99.95% | 0.02% | 0.05% | 99.98% | 0.01% | 0.05% | 100.00% | 0.01% | 0.02% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.02% | 0.01% | 99.87% | 0.02% | 99.95% | 99.89% | 0.00% | 0.00% | 0.00% |
| nogRNA-G1322spilt-KKH-Cas9-G1322-C and dSpCas9-G1322-N | T | 0.00% | 0.01% | 0.01% | 0.00% | 0.00% | 0.00% | 0.00% | 0.03% | 99.95% |
| nogRNA-G1322spilt-KKH-Cas9-G1322-C and dSpCas9-G1322-N | C | 0.00% | 99.96% | 0.03% | 0.00% | 0.01% | 0.02% | 0.00% | 99.96% | 0.02% |
| nogRNA-G1322spilt-KKH-Cas9-G1322-C and dSpCas9-G1322-N | G | 99.97% | 0.02% | 0.08% | 99.98% | 0.03% | 0.09% | 99.99% | 0.02% | 0.03% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.02% | 0.00% | 99.94% | 0.01% | 99.96% | 99.85% | 0.00% | 0.00% | 0.00% |
| nogRNA-G1333spilt-KKH-Cas9-G1333-N and dSpCas9-G1333-C | T | 0.01% | 0.02% | 0.00% | 0.00% | 0.00% | 0.00% | 0.01% | 0.01% | 99.97% |
| nogRNA-G1333spilt-KKH-Cas9-G1333-N and dSpCas9-G1333-C | C | 0.00% | 99.96% | 0.01% | 0.00% | 0.02% | 0.05% | 0.01% | 99.98% | 0.01% |
| nogRNA-G1333spilt-KKH-Cas9-G1333-N and dSpCas9-G1333-C | G | 99.96% | 0.02% | 0.04% | 99.99% | 0.02% | 0.10% | 99.98% | 0.00% | 0.02% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.03% | 0.01% | 99.93% | 0.00% | 99.95% | 99.88% | 0.00% | 0.00% | 0.00% |
| nogRNA-G1333spilt-KKH-Cas9-G1333-C and dSpCas9-G1333-N | T | 0.01% | 0.01% | 0.00% | 0.01% | 0.00% | 0.00% | 0.00% | 0.01% | 99.94% |
| nogRNA-G1333spilt-KKH-Cas9-G1333-C and dSpCas9-G1333-N | C | 0.01% | 99.95% | 0.01% | 0.00% | 0.03% | 0.03% | 0.01% | 99.99% | 0.04% |
| nogRNA-G1333spilt-KKH-Cas9-G1333-C and dSpCas9-G1333-N | G | 99.95% | 0.01% | 0.05% | 99.99% | 0.02% | 0.09% | 99.99% | 0.00% | 0.03% |

TABLE 10C-continued

| No gRNA | | | | | | | | | | |
|---|---|---|---|---|---|---|---|---|---|---|
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.04% | 0.02% | 99.92% | 0.01% | 99.96% | 99.90% | 0.01% | 0.01% | 0.00% |
| nogRNA-G1371spilt-KKH-Cas9-G1371-N and dSpCas9-G1371-C | T | 0.00% | 0.00% | 0.00% | 0.00% | 0.01% | 0.00% | 0.00% | 0.01% | 99.94% |
| nogRNA-G1371spilt-KKH-Cas9-G1371-N and dSpCas9-G1371-C | C | 0.00% | 99.96% | 0.01% | 0.00% | 0.03% | 0.01% | 0.00% | 99.98% | 0.03% |
| nogRNA-G1371spilt-KKH-Cas9-G1371-N and dSpCas9-G1371-C | G | 99.95% | 0.01% | 0.06% | 99.98% | 0.01% | 0.08% | 99.99% | 0.00% | 0.03% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.01% | 0.00% | 0.01% | 0.00% | 0.00% | 0.00% | 0.00% | 0.00% |
| nogRNA-G1371spilt-KKH-Cas9-G1371-C and dSpCas9-G1371-N | A | 0.02% | 0.01% | 99.92% | 0.01% | 99.95% | 99.93% | 0.00% | 0.00% | 0.00% |
| nogRNA-G1371spilt-KKH-Cas9-G1371-C and dSpCas9-G1371-N | T | 0.01% | 0.00% | 0.01% | 0.00% | 0.00% | 0.00% | 0.01% | 0.01% | 99.94% |
| nogRNA-G1371spilt-KKH-Cas9-G1371-C and dSpCas9-G1371-N | C | 0.00% | 99.98% | 0.01% | 0.00% | 0.03% | 0.01% | 0.00% | 99.98% | 0.03% |
| nogRNA-G1371spilt-KKH-Cas9-G1371-C and dSpCas9-G1371-N | G | 99.96% | 0.01% | 0.05% | 99.99% | 0.02% | 0.05% | 99.98% | 0.01% | 0.02% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | A | 0.04% | 0.02% | 99.92% | 0.01% | 99.95% | 99.89% | 0.00% | 0.00% | 0.01% |
| nogRNA-G1397spilt-KKH-Cas9-G1397-N and dSpCas9-G1397-C | T | 0.00% | 0.02% | 0.00% | 0.01% | 0.00% | 0.00% | 0.00% | 0.02% | 99.95% |
| nogRNA-G1397spilt-KKH-Cas9-G1397-N and dSpCas9-G1397-C | C | 0.00% | 99.95% | 0.02% | 0.00% | 0.03% | 0.02% | 0.00% | 99.97% | 0.01% |
| nogRNA-G1397spilt-KKH-Cas9-G1397-N and dSpCas9-G1397-C | G | 99.96% | 0.01% | 0.06% | 99.98% | 0.02% | 0.09% | 99.99% | 0.01% | 0.03% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | A | 0.05% | 0.00% | 99.95% | 0.00% | 99.95% | 99.91% | 0.00% | 0.01% | 0.00% |
| nogRNA-G1397spilt-KKH-Cas9-G1397-C and dSpCas9-G1397-N | T | 0.01% | 0.01% | 0.00% | 0.00% | 0.00% | 0.00% | 0.00% | 0.02% | 99.96% |
| nogRNA-G1397spilt-KKH-Cas9-G1397-C and dSpCas9-G1397-N | C | 0.00% | 99.97% | 0.00% | 0.00% | 0.04% | 0.02% | 0.00% | 99.96% | 0.01% |
| nogRNA-G1397spilt-KKH-Cas9-G1397-C and dSpCas9-G1397-N | G | 99.94% | 0.01% | 0.04% | 100.00% | 0.01% | 0.07% | 100.00% | 0.01% | 0.03% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.01% | 0.00% | 0.00% | 0.00% |

TABLE 10C-continued

| | | | | | | | | | | |
|---|---|---|---|---|---|---|---|---|---|---|
| | | No gRNA | | | | | | | | |
| nogRNA-N1357spilt-KKH-Cas9-N1357-N and dSpCas9-N1357-C | A | 0.05% | 0.00% | 99.93% | 0.00% | 99.96% | 99.93% | 0.01% | 0.00% | 0.00% |
| nogRNA-N1357spilt-KKH-Cas9-N1357-N and dSpCas9-N1357-C | T | 0.00% | 0.00% | 0.00% | 0.01% | 0.01% | 0.00% | 0.00% | 0.02% | 99.97% |
| nogRNA-N1357spilt-KKH-Cas9-N1357-N and dSpCas9-N1357-C | C | 0.00% | 99.98% | 0.01% | 0.00% | 0.01% | 0.00% | 0.00% | 99.97% | 0.02% |
| nogRNA-N1357spilt-KKH-Cas9-N1357-N and dSpCas9-N1357-C | G | 99.95% | 0.01% | 0.06% | 99.99% | 0.02% | 0.07% | 99.98% | 0.01% | 0.00% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.05% | 0.02% | 99.84% | 0.01% | 99.90% | 99.82% | 0.02% | 0.00% | 0.01% |
| nogRNA-N1357spilt-KKH-Cas9-N1357-C and dSpCas9-N1357-N | T | 0.00% | 0.02% | 0.02% | 0.00% | 0.01% | 0.00% | 0.00% | 0.01% | 99.97% |
| nogRNA-N1357spilt-KKH-Cas9-N1357-C and dSpCas9-N1357-N | C | 0.01% | 99.96% | 0.08% | 0.00% | 0.06% | 0.07% | 0.00% | 99.98% | 0.01% |
| nogRNA-N1357spilt-KKH-Cas9-N1357-C and dSpCas9-N1357-N | G | 99.94% | 0.01% | 0.06% | 99.99% | 0.04% | 0.11% | 99.98% | 0.02% | 0.02% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | A | 0.03% | 0.02% | 99.93% | 0.01% | 99.94% | 99.88% | 0.01% | 0.00% | 0.01% |
| nogRNA-N1387spilt-KKH-Cas9-N1387-N and dSpCas9-N1387-C | T | 0.01% | 0.02% | 0.00% | 0.00% | 0.00% | 0.00% | 0.00% | 0.03% | 99.92% |
| nogRNA-N1387spilt-KKH-Cas9-N1387-N and dSpCas9-N1387-C | C | 0.01% | 99.96% | 0.01% | 0.00% | 0.03% | 0.04% | 0.00% | 99.96% | 0.02% |
| nogRNA-N1387spilt-KKH-Cas9-N1387-N and dSpCas9-N1387-C | G | 99.96% | 0.00% | 0.05% | 99.99% | 0.03% | 0.08% | 99.99% | 0.00% | 0.05% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.02% | 0.01% | 99.90% | 0.01% | 99.94% | 99.89% | 0.01% | 0.00% | 0.00% |
| nogRNA-N1387spilt-KKH-Cas9-N1387-C and dSpCas9-N1387-N | T | 0.00% | 0.00% | 0.01% | 0.00% | 0.00% | 0.00% | 0.01% | 0.01% | 99.95% |
| nogRNA-N1387spilt-KKH-Cas9-N1387-C and dSpCas9-N1387-N | C | 0.00% | 99.96% | 0.03% | 0.00% | 0.04% | 0.02% | 0.00% | 99.98% | 0.02% |
| nogRNA-N1387spilt-KKH-Cas9-N1387-C and dSpCas9-N1387-N | G | 99.97% | 0.02% | 0.05% | 99.99% | 0.02% | 0.09% | 99.97% | 0.01% | 0.03% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% | 0.00% |

| Batch | Nucleotide | G | G | A | G | G | A | G | G |
|---|---|---|---|---|---|---|---|---|---|
| nogRNA-A1343spilt-KKH-Cas9-A1343-N and dSpCas9-A1343-C | A | 0.00% | 0.00% | 99.83% | 0.00% | 0.01% | 99.85% | 0.02% | 0.00% |

TABLE 10C-continued

| No gRNA | | | | | | | | | |
|---|---|---|---|---|---|---|---|---|---|
| nogRNA-A1343spilt-KKH-Cas9-A1343-N and dSpCas9-A1343-C | T | 0.01% | 0.01% | 0.00% | 0.01% | 0.02% | 0.02% | 0.01% | 0.01% |
| nogRNA-A1343spilt-KKH-Cas9-A1343-N and dSpCas9-A1343-C | C | 0.00% | 0.00% | 0.03% | 0.00% | 0.00% | 0.04% | 0.00% | 0.00% |
| nogRNA-A1343spilt-KKH-Cas9-A1343-N and dSpCas9-A1343-C | G | 99.98% | 99.98% | 0.14% | 99.99% | 99.97% | 0.10% | 99.97% | 99.99% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | A | 0.00% | 0.01% | 99.66% | 0.00% | 0.00% | 99.75% | 0.00% | 0.01% |
| nogRNA-A1343spilt-KKH-Cas9-A1343-C and dSpCas9-A1343-N | T | 0.00% | 0.00% | 0.02% | 0.02% | 0.02% | 0.01% | 0.01% | 0.00% |
| nogRNA-A1343spilt-KKH-Cas9-A1343-C and dSpCas9-A1343-N | C | 0.00% | 0.01% | 0.09% | 0.00% | 0.00% | 0.09% | 0.01% | 0.00% |
| nogRNA-A1343spilt-KKH-Cas9-A1343-C and dSpCas9-A1343-N | G | 99.99% | 99.98% | 0.23% | 99.98% | 99.98% | 0.15% | 99.97% | 99.98% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.00% | 0.00% | 0.00% | 0.01% | 0.01% |
| nogRNA-G1322spilt-KKH-Cas9-G1322-N and dSpCas9-G1322-C | A | 0.00% | 0.02% | 99.80% | 0.00% | 0.01% | 99.83% | 0.00% | 0.01% |
| nogRNA-G1322spilt-KKH-Cas9-G1322-N and dSpCas9-G1322-C | T | 0.00% | 0.00% | 0.01% | 0.01% | 0.01% | 0.01% | 0.00% | 0.01% |
| nogRNA-G1322spilt-KKH-Cas9-G1322-N and dSpCas9-G1322-C | C | 0.00% | 0.00% | 0.02% | 0.00% | 0.00% | 0.03% | 0.00% | 0.01% |
| nogRNA-G1322spilt-KKH-Cas9-G1322-N and dSpCas9-G1322-C | G | 99.99% | 99.98% | 0.17% | 99.99% | 99.98% | 0.13% | 100.00% | 99.98% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | A | 0.01% | 0.04% | 99.78% | 0.00% | 0.01% | 99.82% | 0.00% | 0.01% |
| nogRNA-G1322spilt-KKH-Cas9-G1322-C and dSpCas9-G1322-N | T | 0.01% | 0.00% | 0.02% | 0.00% | 0.00% | 0.01% | 0.00% | 0.02% |
| nogRNA-G1322spilt-KKH-Cas9-G1322-C and dSpCas9-G1322-N | C | 0.00% | 0.00% | 0.01% | 0.00% | 0.00% | 0.06% | 0.00% | 0.00% |
| nogRNA-G1322spilt-KKH-Cas9-G1322-C and dSpCas9-G1322-N | G | 99.98% | 99.96% | 0.19% | 100.00% | 99.99% | 0.10% | 99.99% | 99.97% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | A | 0.00% | 0.02% | 99.74% | 0.01% | 0.02% | 99.80% | 0.01% | 0.01% |
| nogRNA-G1333spilt-KKH-Cas9-G1333-N and dSpCas9-G1333-C | T | 0.01% | 0.00% | 0.00% | 0.02% | 0.01% | 0.02% | 0.00% | 0.00% |
| nogRNA-G1333spilt-KKH-Cas9-G1333-N and dSpCas9-G1333-C | C | 0.00% | 0.00% | 0.04% | 0.00% | 0.00% | 0.04% | 0.00% | 0.00% |

TABLE 10C-continued

| No gRNA | | | | | | | | | |
|---|---|---|---|---|---|---|---|---|---|
| nogRNA-G1333spilt-KKH-Cas9-G1333-N and dSpCas9-G1333-C | G | 99.99% | 99.98% | 0.21% | 99.96% | 99.97% | 0.14% | 99.99% | 99.99% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | A | 0.00% | 0.03% | 99.78% | 0.01% | 0.02% | 99.85% | 0.01% | 0.01% |
| nogRNA-G1333spilt-KKH-Cas9-G1333-C and dSpCas9-G1333-N | T | 0.01% | 0.00% | 0.01% | 0.01% | 0.01% | 0.01% | 0.00% | 0.00% |
| nogRNA-G1333spilt-KKH-Cas9-G1333-C and dSpCas9-G1333-N | C | 0.00% | 0.01% | 0.05% | 0.00% | 0.00% | 0.04% | 0.00% | 0.00% |
| nogRNA-G1333spilt-KKH-Cas9-G1333-C and dSpCas9-G1333-N | G | 99.98% | 99.95% | 0.15% | 99.97% | 99.97% | 0.10% | 99.99% | 99.99% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | A | 0.00% | 0.00% | 99.79% | 0.00% | 0.01% | 99.82% | 0.02% | 0.01% |
| nogRNA-G1371spilt-KKH-Cas9-G1371-N and dSpCas9-G1371-C | T | 0.01% | 0.02% | 0.01% | 0.00% | 0.01% | 0.02% | 0.01% | 0.01% |
| nogRNA-G1371spilt-KKH-Cas9-G1371-N and dSpCas9-G1371-C | C | 0.00% | 0.00% | 0.04% | 0.00% | 0.01% | 0.03% | 0.00% | 0.00% |
| nogRNA-G1371spilt-KKH-Cas9-G1371-N and dSpCas9-G1371-C | G | 99.99% | 99.98% | 0.16% | 100.00% | 99.97% | 0.13% | 99.97% | 99.97% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.00% | 0.00% | 0.00% | 0.01% | 0.01% |
| nogRNA-G1371spilt-KKH-Cas9-G1371-C and dSpCas9-G1371-N | A | 0.00% | 0.01% | 99.79% | 0.00% | 0.00% | 99.80% | 0.01% | 0.00% |
| nogRNA-G1371spilt-KKH-Cas9-G1371-C and dSpCas9-G1371-N | T | 0.02% | 0.01% | 0.01% | 0.01% | 0.02% | 0.00% | 0.02% | 0.01% |
| nogRNA-G1371spilt-KKH-Cas9-G1371-C and dSpCas9-G1371-N | C | 0.00% | 0.00% | 0.03% | 0.00% | 0.00% | 0.05% | 0.00% | 0.00% |
| nogRNA-G1371spilt-KKH-Cas9-G1371-C and dSpCas9-G1371-N | G | 99.97% | 99.98% | 0.17% | 99.99% | 99.98% | 0.15% | 99.95% | 99.98% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.00% | 0.00% | 0.00% | 0.01% | 0.01% |
| nogRNA-G1397spilt-KKH-Cas9-G1397-N and dSpCas9-G1397-C | A | 0.01% | 0.00% | 99.79% | 0.01% | 0.02% | 99.86% | 0.01% | 0.01% |
| nogRNA-G1397spilt-KKH-Cas9-G1397-N and dSpCas9-G1397-C | T | 0.01% | 0.01% | 0.00% | 0.00% | 0.02% | 0.01% | 0.01% | 0.00% |
| nogRNA-G1397spilt-KKH-Cas9-G1397-N and dSpCas9-G1397-C | C | 0.00% | 0.00% | 0.04% | 0.00% | 0.00% | 0.02% | 0.00% | 0.00% |
| nogRNA-G1397spilt-KKH-Cas9-G1397-N and dSpCas9-G1397-C | G | 99.98% | 99.99% | 0.16% | 99.98% | 99.97% | 0.10% | 99.97% | 99.98% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |

TABLE 10C-continued

| No gRNA | | | | | | | | | |
|---|---|---|---|---|---|---|---|---|---|
| nogRNA-G1397spilt-KKH-Cas9-G1397-N and dSpCas9-G1397-C | — | 0.00% | 0.00% | 0.00% | 0.00% | 0.00% | 0.00% | 0.01% | 0.01% |
| nogRNA-G1397spilt-KKH-Cas9-G1397-C and dSpCas9-G1397-N | A | 0.01% | 0.02% | 99.78% | 0.01% | 0.01% | 99.84% | 0.01% | 0.00% |
| nogRNA-G1397spilt-KKH-Cas9-G1397-C and dSpCas9-G1397-N | T | 0.01% | 0.00% | 0.02% | 0.01% | 0.01% | 0.01% | 0.00% | 0.00% |
| nogRNA-G1397spilt-KKH-Cas9-G1397-C and dSpCas9-G1397-N | C | 0.00% | 0.00% | 0.05% | 0.00% | 0.00% | 0.06% | 0.00% | 0.00% |
| nogRNA-G1397spilt-KKH-Cas9-G1397-C and dSpCas9-G1397-N | G | 99.98% | 99.97% | 0.16% | 99.98% | 99.98% | 0.09% | 99.99% | 100.00% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.01% | 0.00% | 0.00% |
| nogRNA-N1357spilt-KKH-Cas9-N1357-N and dSpCas9-N1357-C | A | 0.02% | 0.01% | 99.81% | 0.01% | 0.01% | 99.85% | 0.00% | 0.00% |
| nogRNA-N1357spilt-KKH-Cas9-N1357-N and dSpCas9-N1357-C | T | 0.01% | 0.00% | 0.00% | 0.02% | 0.02% | 0.01% | 0.01% | 0.00% |
| nogRNA-N1357spilt-KKH-Cas9-N1357-N and dSpCas9-N1357-C | C | 0.00% | 0.00% | 0.02% | 0.00% | 0.00% | 0.03% | 0.00% | 0.00% |
| nogRNA-N1357spilt-KKH-Cas9-N1357-N and dSpCas9-N1357-C | G | 99.97% | 99.99% | 0.17% | 99.98% | 99.97% | 0.11% | 99.98% | 99.99% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | A | 0.00% | 0.01% | 99.71% | 0.00% | 0.00% | 99.76% | 0.00% | 0.01% |
| nogRNA-N1357spilt-KKH-Cas9-N1357-C and dSpCas9-N1357-N | T | 0.01% | 0.01% | 0.01% | 0.03% | 0.01% | 0.01% | 0.01% | 0.01% |
| nogRNA-N1357spilt-KKH-Cas9-N1357-C and dSpCas9-N1357-N | C | 0.01% | 0.00% | 0.06% | 0.01% | 0.00% | 0.08% | 0.00% | 0.01% |
| nogRNA-N1357spilt-KKH-Cas9-N1357-C and dSpCas9-N1357-N | G | 99.99% | 99.98% | 0.22% | 99.96% | 99.98% | 0.15% | 99.98% | 99.96% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.01% | 0.00% | 0.01% | 0.00% | 0.01% | 0.02% |
| nogRNA-N1387spilt-KKH-Cas9-N1387-N and dSpCas9-N1387-C | A | 0.01% | 0.01% | 99.79% | 0.00% | 0.00% | 99.81% | 0.00% | 0.01% |
| nogRNA-N1387spilt-KKH-Cas9-N1387-N and dSpCas9-N1387-C | T | 0.00% | 0.02% | 0.01% | 0.00% | 0.00% | 0.01% | 0.02% | 0.00% |
| nogRNA-N1387spilt-KKH-Cas9-N1387-N and dSpCas9-N1387-C | C | 0.00% | 0.00% | 0.04% | 0.00% | 0.00% | 0.04% | 0.00% | 0.00% |
| nogRNA-N1387spilt-KKH-Cas9-N1387-N and dSpCas9-N1387-C | G | 99.98% | 99.97% | 0.15% | 99.99% | 99.99% | 0.14% | 99.97% | 99.98% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | A | 0.00% | 0.00% | 99.74% | 0.01% | 0.01% | 99.82% | 0.00% | 0.00% |

TABLE 10C-continued

| | | | | | | | | | |
|---|---|---|---|---|---|---|---|---|---|
| No gRNA | | | | | | | | | |
| nogRNA-N1387spilt-KKH-Cas9-N1387-C and dSpCas9-N1387-N | T | 0.01% | 0.01% | 0.02% | 0.01% | 0.01% | 0.01% | 0.01% | 0.00% |
| nogRNA-N1387spilt-KKH-Cas9-N1387-C and dSpCas9-N1387-N | C | 0.00% | 0.00% | 0.04% | 0.00% | 0.00% | 0.04% | 0.00% | 0.00% |
| nogRNA-N1387spilt-KKH-Cas9-N1387-C and dSpCas9-N1387-N | G | 99.99% | 99.98% | 0.20% | 99.97% | 99.97% | 0.13% | 99.98% | 99.99% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.00% | 0.00% | 0.00% | 0.00% | 0.00% |

| Batch | Nucleotide | A | A | G | G | G | C | C |
|---|---|---|---|---|---|---|---|---|
| nogRNA-A1343spilt-KKH-Cas9-A1343-N and dSpCas9-A1343-C | A | 99.87% | 99.97% | 0.01% | 0.01% | 0.01% | 0.03% | 0.02% |
| nogRNA-A1343spilt-KKH-Cas9-A1343-N and dSpCas9-A1343-C | T | 0.02% | 0.00% | 0.01% | 0.01% | 0.00% | 0.05% | 0.05% |
| nogRNA-A1343spilt-KKH-Cas9-A1343-N and dSpCas9-A1343-C | C | 0.00% | 0.00% | 0.00% | 0.00% | 0.01% | 99.88% | 99.90% |
| nogRNA-A1343spilt-KKH-Cas9-A1343-N and dSpCas9-A1343-C | G | 0.11% | 0.02% | 99.98% | 99.98% | 99.98% | 0.03% | 0.02% |
| nogRNA-A1343spilt-KKH-Cas9-A1343-N and dSpCas9-A1343-C | N | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.00% | 0.00% | 0.00% | 0.00% |
| nogRNA-A1343spilt-KKH-Cas9-A1343-C and dSpCas9-A1343-N | A | 99.80% | 99.89% | 0.03% | 0.00% | 0.01% | 0.03% | 0.02% |
| nogRNA-A1343spilt-KKH-Cas9-A1343-C and dSpCas9-A1343-N | T | 0.00% | 0.01% | 0.01% | 0.00% | 0.01% | 0.04% | 0.07% |
| nogRNA-A1343spilt-KKH-Cas9-A1343-C and dSpCas9-A1343-N | C | 0.05% | 0.06% | 0.00% | 0.00% | 0.00% | 99.91% | 99.90% |
| nogRNA-A1343spilt-KKH-Cas9-A1343-C and dSpCas9-A1343-N | G | 0.13% | 0.04% | 99.95% | 99.99% | 99.98% | 0.03% | 0.01% |
| nogRNA-A1343spilt-KKH-Cas9-A1343-C and dSpCas9-A1343-N | N | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.01% | 0.00% | 0.00% | 0.00% | 0.00% | 0.00% | 0.00% |
| nogRNA-G1322spilt-KKH-Cas9-G1322-N and dSpCas9-G1322-C | A | 99.88% | 99.95% | 0.03% | 0.00% | 0.00% | 0.01% | 0.03% |
| nogRNA-G1322spilt-KKH-Cas9-G1322-N and dSpCas9-G1322-C | T | 0.00% | 0.02% | 0.00% | 0.01% | 0.00% | 0.03% | 0.09% |
| nogRNA-G1322spilt-KKH-Cas9-G1322-N and dSpCas9-G1322-C | C | 0.02% | 0.01% | 0.00% | 0.00% | 0.00% | 99.93% | 99.86% |
| nogRNA-G1322spilt-KKH-Cas9-G1322-N and dSpCas9-G1322-C | G | 0.09% | 0.01% | 99.97% | 99.99% | 99.99% | 0.03% | 0.01% |
| nogRNA-G1322spilt-KKH-Cas9-G1322-N and dSpCas9-G1322-C | N | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.00% | 0.01% | 0.00% | 0.01% |
| nogRNA-G1322spilt-KKH-Cas9-G1322-C and dSpCas9-G1322-N | A | 99.77% | 99.92% | 0.02% | 0.00% | 0.01% | 0.03% | 0.02% |
| nogRNA-G1322spilt-KKH-Cas9-G1322-C and dSpCas9-G1322-N | T | 0.02% | 0.01% | 0.04% | 0.01% | 0.00% | 0.05% | 0.10% |

TABLE 10C-continued

| No gRNA | | | | | | | | |
|---|---|---|---|---|---|---|---|---|
| nogRNA-G1322spilt-KKH-Cas9-G1322-C and dSpCas9-G1322-N | C | 0.03% | 0.01% | 0.00% | 0.00% | 0.00% | 99.88% | 99.86% |
| nogRNA-G1322spilt-KKH-Cas9-G1322-C and dSpCas9-G1322-N | G | 0.17% | 0.05% | 99.94% | 99.99% | 99.99% | 0.05% | 0.02% |
| nogRNA-G1322spilt-KKH-Cas9-G1322-C and dSpCas9-G1322-N | N | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.01% | 0.00% | 0.00% | 0.00% | 0.00% | 0.00% | 0.00% |
| nogRNA-G1333spilt-KKH-Cas9-G1333-N and dSpCas9-G1333-C | A | 99.80% | 99.91% | 0.03% | 0.01% | 0.00% | 0.02% | 0.03% |
| nogRNA-G1333spilt-KKH-Cas9-G1333-N and dSpCas9-G1333-C | T | 0.02% | 0.01% | 0.01% | 0.00% | 0.02% | 0.03% | 0.06% |
| nogRNA-G1333spilt-KKH-Cas9-G1333-N and dSpCas9-G1333-C | C | 0.00% | 0.02% | 0.00% | 0.00% | 0.00% | 99.90% | 99.88% |
| nogRNA-G1333spilt-KKH-Cas9-G1333-N and dSpCas9-G1333-C | G | 0.18% | 0.06% | 99.96% | 99.98% | 99.97% | 0.05% | 0.01% |
| nogRNA-G1333spilt-KKH-Cas9-G1333-N and dSpCas9-G1333-C | N | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.00% | 0.00% | 0.00% | 0.00% | 0.01% |
| nogRNA-G1333spilt-KKH-Cas9-G1333-C and dSpCas9-G1333-N | A | 99.83% | 99.96% | 0.00% | 0.02% | 0.00% | 0.01% | 0.02% |
| nogRNA-G1333spilt-KKH-Cas9-G1333-C and dSpCas9-G1333-N | T | 0.03% | 0.01% | 0.01% | 0.00% | 0.00% | 0.04% | 0.09% |
| nogRNA-G1333spilt-KKH-Cas9-G1333-C and dSpCas9-G1333-N | C | 0.01% | 0.01% | 0.01% | 0.00% | 0.00% | 99.92% | 99.88% |
| nogRNA-G1333spilt-KKH-Cas9-G1333-C and dSpCas9-G1333-N | G | 0.13% | 0.02% | 99.98% | 99.97% | 99.99% | 0.03% | 0.00% |
| nogRNA-G1333spilt-KKH-Cas9-G1333-C and dSpCas9-G1333-N | N | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.00% | 0.01% | 0.00% | 0.01% |
| nogRNA-G1371spilt-KKH-Cas9-G1371-N and dSpCas9-G1371-C | A | 99.82% | 99.94% | 0.02% | 0.02% | 0.00% | 0.02% | 0.01% |
| nogRNA-G1371spilt-KKH-Cas9-G1371-N and dSpCas9-G1371-C | T | 0.01% | 0.00% | 0.01% | 0.00% | 0.00% | 0.05% | 0.08% |
| nogRNA-G1371spilt-KKH-Cas9-G1371-N and dSpCas9-G1371-C | C | 0.02% | 0.01% | 0.00% | 0.00% | 0.00% | 99.89% | 99.87% |
| nogRNA-G1371spilt-KKH-Cas9-G1371-N and dSpCas9-G1371-C | G | 0.14% | 0.04% | 99.97% | 99.98% | 99.98% | 0.03% | 0.02% |
| nogRNA-G1371spilt-KKH-Cas9-G1371-N and dSpCas9-G1371-C | N | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.01% | 0.00% | 0.00% | 0.00% | 0.01% | 0.00% | 0.02% |
| nogRNA-G1371spilt-KKH-Cas9-G1371-C and dSpCas9-G1371-N | A | 99.83% | 99.92% | 0.02% | 0.02% | 0.00% | 0.02% | 0.01% |
| nogRNA-G1371spilt-KKH-Cas9-G1371-C and dSpCas9-G1371-N | T | 0.01% | 0.01% | 0.01% | 0.00% | 0.01% | 0.06% | 0.09% |
| nogRNA-G1371spilt-KKH-Cas9-G1371-C and dSpCas9-G1371-N | C | 0.01% | 0.02% | 0.00% | 0.01% | 0.00% | 99.88% | 99.89% |
| nogRNA-G1371spilt-KKH-Cas9-G1371-C and dSpCas9-G1371-N | G | 0.14% | 0.05% | 99.96% | 99.97% | 99.99% | 0.03% | 0.00% |

TABLE 10C-continued

| No gRNA | | | | | | | | |
|---|---|---|---|---|---|---|---|---|
| nogRNA-G1371spilt-KKH-Cas9-G1371-C and dSpCas9-G1371-N | N | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.01% | 0.00% | 0.00% | 0.00% | 0.00% | 0.00% | 0.00% |
| nogRNA-G1397spilt-KKH-Cas9-G1397-N and dSpCas9-G1397-C | A | 99.83% | 99.93% | 0.02% | 0.02% | 0.01% | 0.05% | 0.02% |
| nogRNA-G1397spilt-KKH-Cas9-G1397-N and dSpCas9-G1397-C | T | 0.01% | 0.00% | 0.00% | 0.00% | 0.00% | 0.06% | 0.09% |
| nogRNA-G1397spilt-KKH-Cas9-G1397-N and dSpCas9-G1397-C | C | 0.02% | 0.01% | 0.00% | 0.00% | 0.01% | 99.87% | 99.87% |
| nogRNA-G1397spilt-KKH-Cas9-G1397-N and dSpCas9-G1397-C | G | 0.13% | 0.05% | 99.98% | 99.97% | 99.98% | 0.02% | 0.02% |
| nogRNA-G1397spilt-KKH-Cas9-G1397-N and dSpCas9-G1397-C | N | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.01% | 0.01% | 0.00% | 0.00% | 0.00% | 0.00% | 0.00% |
| nogRNA-G1397spilt-KKH-Cas9-G1397-C and dSpCas9-G1397-N | A | 99.78% | 99.95% | 0.01% | 0.01% | 0.01% | 0.02% | 0.03% |
| nogRNA-G1397spilt-KKH-Cas9-G1397-C and dSpCas9-G1397-N | T | 0.02% | 0.00% | 0.02% | 0.00% | 0.00% | 0.05% | 0.08% |
| nogRNA-G1397spilt-KKH-Cas9-G1397-C and dSpCas9-G1397-N | C | 0.02% | 0.01% | 0.00% | 0.00% | 0.00% | 99.89% | 99.86% |
| nogRNA-G1397spilt-KKH-Cas9-G1397-C and dSpCas9-G1397-N | G | 0.18% | 0.03% | 99.98% | 99.99% | 99.99% | 0.03% | 0.02% |
| nogRNA-G1397spilt-KKH-Cas9-G1397-C and dSpCas9-G1397-N | N | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.00% | 0.00% | 0.00% | 0.01% |
| nogRNA-N1357spilt-KKH-Cas9-N1357-N and dSpCas9-N1357-C | A | 99.82% | 99.94% | 0.02% | 0.01% | 0.01% | 0.02% | 0.03% |
| nogRNA-N1357spilt-KKH-Cas9-N1357-N and dSpCas9-N1357-C | T | 0.02% | 0.01% | 0.01% | 0.01% | 0.01% | 0.05% | 0.11% |
| nogRNA-N1357spilt-KKH-Cas9-N1357-N and dSpCas9-N1357-C | C | 0.02% | 0.01% | 0.00% | 0.00% | 0.00% | 99.90% | 99.84% |
| nogRNA-N1357spilt-KKH-Cas9-N1357-N and dSpCas9-N1357-C | G | 0.15% | 0.05% | 99.96% | 99.98% | 99.97% | 0.02% | 0.01% |
| nogRNA-N1357spilt-KKH-Cas9-N1357-N and dSpCas9-N1357-C | N | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.00% | 0.00% | 0.00% | 0.00% | 0.00% | 0.00% | 0.00% |
| nogRNA-N1357spilt-KKH-Cas9-N1357-C and dSpCas9-N1357-N | A | 99.65% | 99.92% | 0.02% | 0.00% | 0.01% | 0.03% | 0.01% |
| nogRNA-N1357spilt-KKH-Cas9-N1357-C and dSpCas9-N1357-N | T | 0.01% | 0.00% | 0.01% | 0.00% | 0.01% | 0.03% | 0.13% |
| nogRNA-N1357spilt-KKH-Cas9-N1357-C and dSpCas9-N1357-N | C | 0.07% | 0.04% | 0.00% | 0.00% | 0.00% | 99.92% | 99.84% |
| nogRNA-N1357spilt-KKH-Cas9-N1357-C and dSpCas9-N1357-N | G | 0.26% | 0.04% | 99.98% | 100.00% | 99.98% | 0.03% | 0.02% |
| nogRNA-N1357spilt-KKH-Cas9-N1357-C and dSpCas9-N1357-N | N | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.01% | 0.00% | 0.00% | 0.00% | 0.00% | 0.00% | 0.00% |

TABLE 10C-continued

| | | | | | | | | |
|---|---|---|---|---|---|---|---|---|
| | | No gRNA | | | | | | |
| nogRNA-N1387spilt-KKH-Cas9-N1387-N and dSpCas9-N1387-C | A | 99.79% | 99.93% | 0.02% | 0.01% | 0.00% | 0.03% | 0.02% |
| nogRNA-N1387spilt-KKH-Cas9-N1387-N and dSpCas9-N1387-C | T | 0.01% | 0.00% | 0.01% | 0.00% | 0.00% | 0.03% | 0.16% |
| nogRNA-N1387spilt-KKH-Cas9-N1387-N and dSpCas9-N1387-C | C | 0.04% | 0.00% | 0.00% | 0.00% | 0.00% | 99.92% | 99.78% |
| nogRNA-N1387spilt-KKH-Cas9-N1387-N and dSpCas9-N1387-C | G | 0.17% | 0.06% | 99.97% | 99.99% | 100.00% | 0.03% | 0.02% |
| nogRNA-N1387spilt-KKH-Cas9-N1387-N and dSpCas9-N1387-C | N | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.00% | 0.00% | 0.00% | 0.00% | 0.00% | 0.00% | 0.01% |
| nogRNA-N1387spilt-KKH-Cas9-N1387-C and dSpCas9-N1387-N | A | 99.79% | 99.93% | 0.02% | 0.01% | 0.00% | 0.03% | 0.01% |
| nogRNA-N1387spilt-KKH-Cas9-N1387-C and dSpCas9-N1387-N | T | 0.02% | 0.00% | 0.02% | 0.00% | 0.00% | 0.05% | 0.05% |
| nogRNA-N1387spilt-KKH-Cas9-N1387-C and dSpCas9-N1387-N | C | 0.01% | 0.01% | 0.00% | 0.00% | 0.00% | 99.89% | 99.91% |
| nogRNA-N1387spilt-KKH-Cas9-N1387-C and dSpCas9-N1387-N | G | 0.17% | 0.04% | 99.96% | 99.99% | 99.99% | 0.04% | 0.01% |
| nogRNA-N1387spilt-KKH-Cas9-N1387-C and dSpCas9-N1387-N | N | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.01% | 0.01% | 0.00% | 0.00% | 0.00% | 0.00% | 0.01% |

| Batch | Nucleotide | T | G | A | G | T | C | C | G |
|---|---|---|---|---|---|---|---|---|---|
| nogRNA-A1343spilt-KKH-Cas9-A1343-N and dSpCas9-A1343-C | A | 0.02% | 0.03% | 99.90% | 0.01% | 0.02% | 0.02% | 0.02% | 0.01% |
| nogRNA-A1343spilt-KKH-Cas9-A1343-N and dSpCas9-A1343-C | T | 99.88% | 0.01% | 0.00% | 0.00% | 99.83% | 0.06% | 0.05% | 0.01% |
| nogRNA-A1343spilt-KKH-Cas9-A1343-N and dSpCas9-A1343-C | C | 0.05% | 0.00% | 0.02% | 0.00% | 0.05% | 99.92% | 99.81% | 0.00% |
| nogRNA-A1343spilt-KKH-Cas9-A1343-N and dSpCas9-A1343-C | G | 0.05% | 99.96% | 0.07% | 99.95% | 0.04% | 0.00% | 0.03% | 99.92% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.00% | 0.00% | 0.00% | 0.04% | 0.07% | 0.00% | 0.09% | 0.05% |
| nogRNA-A1343spilt-KKH-Cas9-A1343-C and dSpCas9-A1343-N | A | 0.01% | 0.01% | 99.79% | 0.00% | 0.00% | 0.02% | 0.02% | 0.02% |
| nogRNA-A1343spilt-KKH-Cas9-A1343-C and dSpCas9-A1343-N | T | 99.92% | 0.02% | 0.01% | 0.00% | 99.82% | 0.04% | 0.08% | 0.01% |
| nogRNA-A1343spilt-KKH-Cas9-A1343-C and dSpCas9-A1343-N | C | 0.03% | 0.00% | 0.07% | 0.00% | 0.05% | 99.93% | 99.75% | 0.00% |
| nogRNA-A1343spilt-KKH-Cas9-A1343-C and dSpCas9-A1343-N | G | 0.04% | 99.96% | 0.12% | 99.97% | 0.03% | 0.01% | 0.03% | 99.90% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.00% | 0.00% | 0.00% | 0.01% | 0.09% | 0.00% | 0.13% | 0.06% |
| nogRNA-G1322spilt-KKH-Cas9-G1322-N and dSpCas9-G1322-C | A | 0.00% | 0.01% | 99.87% | 0.01% | 0.02% | 0.01% | 0.02% | 0.02% |

TABLE 10C-continued

| No gRNA | | | | | | | | | |
|---|---|---|---|---|---|---|---|---|---|
| nogRNA-G1322spilt-KKH-Cas9-G1322-N and dSpCas9-G1322-C | T | 99.93% | 0.01% | 0.00% | 0.00% | 99.83% | 0.04% | 0.08% | 0.01% |
| nogRNA-G1322spilt-KKH-Cas9-G1322-N and dSpCas9-G1322-C | C | 0.03% | 0.00% | 0.03% | 0.00% | 0.07% | 99.95% | 99.79% | 0.00% |
| nogRNA-G1322spilt-KKH-Cas9-G1322-N and dSpCas9-G1322-C | G | 0.03% | 99.97% | 0.10% | 99.96% | 0.05% | 0.00% | 0.02% | 99.89% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.00% | 0.00% | 0.00% | 0.03% | 0.03% | 0.00% | 0.10% | 0.08% |
| nogRNA-G1322spilt-KKH-Cas9-G1322-C and dSpCas9-G1322-N | A | 0.01% | 0.03% | 99.85% | 0.00% | 0.03% | 0.01% | 0.01% | 0.01% |
| nogRNA-G1322spilt-KKH-Cas9-G1322-C and dSpCas9-G1322-N | T | 99.87% | 0.03% | 0.00% | 0.00% | 99.81% | 0.06% | 0.05% | 0.01% |
| nogRNA-G1322spilt-KKH-Cas9-G1322-C and dSpCas9-G1322-N | C | 0.07% | 0.00% | 0.03% | 0.00% | 0.05% | 99.92% | 99.83% | 0.00% |
| nogRNA-G1322spilt-KKH-Cas9-G1322-C and dSpCas9-G1322-N | G | 0.04% | 99.94% | 0.11% | 99.97% | 0.06% | 0.00% | 0.02% | 99.89% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.00% | 0.00% | 0.01% | 0.02% | 0.05% | 0.00% | 0.09% | 0.09% |
| nogRNA-G1333spilt-KKH-Cas9-G1333-N and dSpCas9-G1333-C | A | 0.01% | 0.01% | 99.87% | 0.01% | 0.03% | 0.01% | 0.00% | 0.01% |
| nogRNA-G1333spilt-KKH-Cas9-G1333-N and dSpCas9-G1333-C | T | 99.94% | 0.00% | 0.00% | 0.00% | 99.85% | 0.04% | 0.03% | 0.00% |
| nogRNA-G1333spilt-KKH-Cas9-G1333-N and dSpCas9-G1333-C | C | 0.02% | 0.00% | 0.03% | 0.00% | 0.04% | 99.94% | 99.87% | 0.00% |
| nogRNA-G1333spilt-KKH-Cas9-G1333-N and dSpCas9-G1333-C | G | 0.02% | 99.99% | 0.09% | 99.96% | 0.04% | 0.01% | 0.00% | 99.91% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.00% | 0.00% | 0.01% | 0.03% | 0.04% | 0.00% | 0.09% | 0.07% |
| nogRNA-G1333spilt-KKH-Cas9-G1333-C and dSpCas9-G1333-N | A | 0.00% | 0.01% | 99.87% | 0.00% | 0.00% | 0.00% | 0.00% | 0.02% |
| nogRNA-G1333spilt-KKH-Cas9-G1333-C and dSpCas9-G1333-N | T | 99.91% | 0.00% | 0.00% | 0.01% | 99.85% | 0.06% | 0.02% | 0.01% |
| nogRNA-G1333spilt-KKH-Cas9-G1333-C and dSpCas9-G1333-N | C | 0.05% | 0.00% | 0.04% | 0.00% | 0.07% | 99.92% | 99.86% | 0.00% |
| nogRNA-G1333spilt-KKH-Cas9-G1333-C and dSpCas9-G1333-N | G | 0.04% | 99.99% | 0.08% | 99.92% | 0.04% | 0.01% | 0.01% | 99.90% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.00% | 0.00% | 0.00% | 0.06% | 0.04% | 0.00% | 0.10% | 0.06% |
| nogRNA-G1371spilt-KKH-Cas9-G1371-N and dSpCas9-G1371-C | A | 0.00% | 0.03% | 99.86% | 0.02% | 0.02% | 0.01% | 0.02% | 0.03% |
| nogRNA-G1371spilt-KKH-Cas9-G1371-N and dSpCas9-G1371-C | T | 99.92% | 0.00% | 0.00% | 0.01% | 99.84% | 0.04% | 0.05% | 0.00% |
| nogRNA-G1371spilt-KKH-Cas9-G1371-N and dSpCas9-G1371-C | C | 0.04% | 0.00% | 0.03% | 0.00% | 0.06% | 99.94% | 99.83% | 0.00% |

TABLE 10C-continued

| No gRNA | | | | | | | | | |
|---|---|---|---|---|---|---|---|---|---|
| nogRNA-G1371spilt-KKH-Cas9-G1371-N and dSpCas9-G1371-C | G | 0.03% | 99.97% | 0.11% | 99.95% | 0.04% | 0.00% | 0.00% | 99.91% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.00% | 0.00% | 0.00% | 0.02% | 0.05% | 0.01% | 0.11% | 0.06% |
| nogRNA-G1371spilt-KKH-Cas9-G1371-C and dSpCas9-G1371-N | A | 0.01% | 0.02% | 99.85% | 0.00% | 0.01% | 0.02% | 0.01% | 0.02% |
| nogRNA-G1371spilt-KKH-Cas9-G1371-C and dSpCas9-G1371-N | T | 99.91% | 0.02% | 0.01% | 0.01% | 99.82% | 0.05% | 0.04% | 0.01% |
| nogRNA-G1371spilt-KKH-Cas9-G1371-C and dSpCas9-G1371-N | C | 0.04% | 0.00% | 0.04% | 0.00% | 0.06% | 99.92% | 99.85% | 0.00% |
| nogRNA-G1371spilt-KKH-Cas9-G1371-C and dSpCas9-G1371-N | G | 0.05% | 99.95% | 0.11% | 99.98% | 0.05% | 0.00% | 0.02% | 99.91% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.00% | 0.00% | 0.00% | 0.01% | 0.06% | 0.00% | 0.08% | 0.07% |
| nogRNA-G1397spilt-KKH-Cas9-G1397-N and dSpCas9-G1397-C | A | 0.01% | 0.01% | 99.84% | 0.01% | 0.00% | 0.02% | 0.00% | 0.02% |
| nogRNA-G1397spilt-KKH-Cas9-G1397-N and dSpCas9-G1397-C | T | 99.91% | 0.02% | 0.01% | 0.00% | 99.87% | 0.05% | 0.07% | 0.00% |
| nogRNA-G1397spilt-KKH-Cas9-G1397-N and dSpCas9-G1397-C | C | 0.05% | 0.00% | 0.03% | 0.00% | 0.04% | 99.92% | 99.83% | 0.00% |
| nogRNA-G1397spilt-KKH-Cas9-G1397-N and dSpCas9-G1397-C | G | 0.02% | 99.96% | 0.12% | 99.96% | 0.03% | 0.01% | 0.02% | 99.90% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.00% | 0.00% | 0.00% | 0.03% | 0.05% | 0.00% | 0.08% | 0.09% |
| nogRNA-G1397spilt-KKH-Cas9-G1397-C and dSpCas9-G1397-N | A | 0.01% | 0.01% | 99.87% | 0.00% | 0.02% | 0.02% | 0.02% | 0.03% |
| nogRNA-G1397spilt-KKH-Cas9-G1397-C and dSpCas9-G1397-N | T | 99.90% | 0.01% | 0.00% | 0.00% | 99.85% | 0.03% | 0.06% | 0.00% |
| nogRNA-G1397spilt-KKH-Cas9-G1397-C and dSpCas9-G1397-N | C | 0.05% | 0.00% | 0.04% | 0.00% | 0.05% | 99.94% | 99.79% | 0.00% |
| nogRNA-G1397spilt-KKH-Cas9-G1397-C and dSpCas9-G1397-N | G | 0.02% | 99.98% | 0.08% | 99.97% | 0.04% | 0.01% | 0.03% | 99.88% |
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.00% | 0.00% | 0.00% | 0.03% | 0.04% | 0.00% | 0.10% | 0.09% |
| nogRNA-N1357spilt-KKH-Cas9-N1357-N and dSpCas9-N1357-C | A | 0.02% | 0.03% | 99.84% | 0.01% | 0.01% | 0.01% | 0.00% | 0.02% |
| nogRNA-N1357spilt-KKH-Cas9-N1357-N and dSpCas9-N1357-C | T | 99.91% | 0.01% | 0.01% | 0.00% | 99.87% | 0.05% | 0.06% | 0.00% |
| nogRNA-N1357spilt-KKH-Cas9-N1357-N and dSpCas9-N1357-C | C | 0.03% | 0.00% | 0.04% | 0.00% | 0.04% | 99.94% | 99.84% | 0.00% |
| nogRNA-N1357spilt-KKH-Cas9-N1357-N and dSpCas9-N1357-C | G | 0.03% | 99.96% | 0.11% | 99.96% | 0.04% | 0.01% | 0.02% | 99.89% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |

TABLE 10C-continued

| | | No gRNA | | | | | | | |
|---|---|---|---|---|---|---|---|---|---|
| nogRNA-N1357spilt-KKH-Cas9-N1357-N and dSpCas9-N1357-C | — | 0.00% | 0.00% | 0.01% | 0.03% | 0.03% | 0.00% | 0.08% | 0.09% |
| nogRNA-N1357spilt-KKH-Cas9-N1357-C and dSpCas9-N1357-N | A | 0.01% | 0.01% | 99.80% | 0.01% | 0.02% | 0.02% | 0.02% | 0.01% |
| nogRNA-N1357spilt-KKH-Cas9-N1357-C and dSpCas9-N1357-N | T | 99.91% | 0.01% | 0.01% | 0.01% | 99.87% | 0.02% | 0.06% | 0.02% |
| nogRNA-N1357spilt-KKH-Cas9-N1357-C and dSpCas9-N1357-N | C | 0.03% | 0.00% | 0.06% | 0.00% | 0.04% | 99.96% | 99.80% | 0.01% |
| nogRNA-N1357spilt-KKH-Cas9-N1357-C and dSpCas9-N1357-N | G | 0.04% | 99.99% | 0.13% | 99.97% | 0.03% | 0.01% | 0.02% | 99.86% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.00% | 0.00% | 0.00% | 0.02% | 0.05% | 0.01% | 0.11% | 0.10% |
| nogRNA-N1387spilt-KKH-Cas9-N1387-N and dSpCas9-N1387-C | A | 0.00% | 0.01% | 99.82% | 0.00% | 0.02% | 0.03% | 0.03% | 0.02% |
| nogRNA-N1387spilt-KKH-Cas9-N1387-N and dSpCas9-N1387-C | T | 99.88% | 0.00% | 0.01% | 0.00% | 99.82% | 0.04% | 0.07% | 0.00% |
| nogRNA-N1387spilt-KKH-Cas9-N1387-N and dSpCas9-N1387-C | C | 0.07% | 0.00% | 0.03% | 0.00% | 0.08% | 99.94% | 99.77% | 0.00% |
| nogRNA-N1387spilt-KKH-Cas9-N1387-N and dSpCas9-N1387-C | G | 0.04% | 99.98% | 0.12% | 99.96% | 0.04% | 0.00% | 0.04% | 99.89% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.01% | 0.00% | 0.01% | 0.03% | 0.04% | 0.00% | 0.09% | 0.09% |
| nogRNA-N1387spilt-KKH-Cas9-N1387-C and dSpCas9-N1387-N | A | 0.00% | 0.03% | 99.86% | 0.01% | 0.01% | 0.01% | 0.00% | 0.01% |
| nogRNA-N1387spilt-KKH-Cas9-N1387-C and dSpCas9-N1387-N | T | 99.92% | 0.01% | 0.00% | 0.01% | 99.80% | 0.05% | 0.08% | 0.00% |
| nogRNA-N1387spilt-KKH-Cas9-N1387-C and dSpCas9-N1387-N | C | 0.04% | 0.00% | 0.02% | 0.00% | 0.06% | 99.93% | 99.76% | 0.00% |
| nogRNA-N1387spilt-KKH-Cas9-N1387-C and dSpCas9-N1387-N | G | 0.03% | 99.96% | 0.12% | 99.96% | 0.08% | 0.00% | 0.02% | 99.85% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |
| nogRNA-N1387spilt-KKH-Cas9-N1387-C and dSpCas9-N1387-N | — | 0.00% | 0.00% | 0.00% | 0.02% | 0.05% | 0.00% | 0.14% | 0.13% |
| Batch | Nucleotide | A | G | C | A | G | A | A | G |
| nogRNA-A1343spilt-KKH-Cas9-A1343-N and dSpCas9-A1343-C | A | 99.85% | 0.00% | 0.02% | 2.31% | 0.10% | 2.16% | 0.01% | 0.00% |
| nogRNA-A1343spilt-KKH-Cas9-A1343-N and dSpCas9-A1343-C | T | 0.01% | 0.01% | 0.02% | 0.01% | 0.01% | 0.00% | 0.00% | 0.00% |
| nogRNA-A1343spilt-KKH-Cas9-A1343-N and dSpCas9-A1343-C | C | 0.03% | 0.00% | 99.95% | 0.05% | 0.01% | 0.00% | 0.00% | 0.00% |
| nogRNA-A1343spilt-KKH-Cas9-A1343-N and dSpCas9-A1343-C | G | 0.07% | 99.96% | 0.00% | 0.10% | 2.34% | 0.06% | 0.00% | 0.01% |
| nogRNA-A1343spilt-KKH-Cas9-A1343-N and dSpCas9-A1343-C | N | 0.00% | 0.00% | 0.00% | 0.00% | 0.00% | 0.00% | 0.00% | 0.00% |
| nogRNA-A1343spilt-KKH-Cas9-A1343-N and dSpCas9-A1343-C | — | 0.03% | 0.03% | 0.00% | 97.53% | 97.54% | 97.77% | 99.99% | 99.99% |

TABLE 10C-continued

| | | No gRNA | | | | | | | |
|---|---|---|---|---|---|---|---|---|---|
| nogRNA-A1343spilt-KKH-Cas9-A1343-C and dSpCas9-A1343-N | A | 99.78% | 0.01% | 0.02% | 2.52% | 0.09% | 2.38% | 0.02% | 0.00% |
| nogRNA-A1343spilt-KKH-Cas9-A1343-C and dSpCas9-A1343-N | T | 0.00% | 0.01% | 0.04% | 0.01% | 0.01% | 0.00% | 0.00% | 0.00% |
| nogRNA-A1343spilt-KKH-Cas9-A1343-C and dSpCas9-A1343-N | C | 0.07% | 0.00% | 99.88% | 0.08% | 0.01% | 0.06% | 0.00% | 0.00% |
| nogRNA-A1343spilt-KKH-Cas9-A1343-C and dSpCas9-A1343-N | G | 0.11% | 99.93% | 0.02% | 0.09% | 2.57% | 0.05% | 0.00% | 0.02% |
| nogRNA-A1343spilt-KKH-Cas9-A1343-C and dSpCas9-A1343-N | N | 0.00% | 0.00% | 0.00% | 0.00% | 0.00% | 0.00% | 0.00% | 0.00% |
| nogRNA-A1343spilt-KKH-Cas9-A1343-C and dSpCas9-A1343-N | — | 0.04% | 0.05% | 0.04% | 97.29% | 97.33% | 97.51% | 99.98% | 99.98% |
| nogRNA-G1322spilt-KKH-Cas9-G1322-N and dSpCas9-G1322-C | A | 99.86% | 0.01% | 0.03% | 2.26% | 0.09% | 2.15% | 0.03% | 0.00% |
| nogRNA-G1322spilt-KKH-Cas9-G1322-N and dSpCas9-G1322-C | T | 0.01% | 0.00% | 0.04% | 0.02% | 0.00% | 0.00% | 0.00% | 0.00% |
| nogRNA-G1322spilt-KKH-Cas9-G1322-N and dSpCas9-G1322-C | C | 0.02% | 0.00% | 99.88% | 0.04% | 0.00% | 0.00% | 0.00% | 0.00% |
| nogRNA-G1322spilt-KKH-Cas9-G1322-N and dSpCas9-G1322-C | G | 0.09% | 99.94% | 0.03% | 0.12% | 2.32% | 0.03% | 0.00% | 0.03% |
| nogRNA-G1322spilt-KKH-Cas9-G1322-N and dSpCas9-G1322-C | N | 0.00% | 0.00% | 0.00% | 0.00% | 0.00% | 0.00% | 0.00% | 0.00% |
| nogRNA-G1322spilt-KKH-Cas9-G1322-N and dSpCas9-G1322-C | — | 0.02% | 0.04% | 0.02% | 97.56% | 97.59% | 97.82% | 99.97% | 99.97% |
| nogRNA-G1322spilt-KKH-Cas9-G1322-C and dSpCas9-G1322-N | A | 99.84% | 0.02% | 0.03% | 2.49% | 0.09% | 2.32% | 0.03% | 0.00% |
| nogRNA-G1322spilt-KKH-Cas9-G1322-C and dSpCas9-G1322-N | T | 0.01% | 0.01% | 0.03% | 0.02% | 0.02% | 0.00% | 0.00% | 0.00% |
| nogRNA-G1322spilt-KKH-Cas9-G1322-C and dSpCas9-G1322-N | C | 0.04% | 0.00% | 99.90% | 0.06% | 0.00% | 0.02% | 0.00% | 0.00% |
| nogRNA-G1322spilt-KKH-Cas9-G1322-C and dSpCas9-G1322-N | G | 0.08% | 99.93% | 0.00% | 0.10% | 2.54% | 0.09% | 0.00% | 0.02% |
| nogRNA-G1322spilt-KKH-Cas9-G1322-C and dSpCas9-G1322-N | N | 0.00% | 0.00% | 0.00% | 0.00% | 0.00% | 0.00% | 0.00% | 0.00% |
| nogRNA-G1322spilt-KKH-Cas9-G1322-C and dSpCas9-G1322-N | — | 0.03% | 0.04% | 0.05% | 97.33% | 97.35% | 97.58% | 99.97% | 99.98% |
| nogRNA-G1333spilt-KKH-Cas9-G1333-N and dSpCas9-G1333-C | A | 99.84% | 0.02% | 0.05% | 2.70% | 0.12% | 2.52% | 0.02% | 0.00% |
| nogRNA-G1333spilt-KKH-Cas9-G1333-N and dSpCas9-G1333-C | T | 0.01% | 0.00% | 0.03% | 0.01% | 0.01% | 0.00% | 0.00% | 0.00% |
| nogRNA-G1333spilt-KKH-Cas9-G1333-N and dSpCas9-G1333-C | C | 0.06% | 0.00% | 99.88% | 0.02% | 0.00% | 0.01% | 0.00% | 0.00% |
| nogRNA-G1333spilt-KKH-Cas9-G1333-N and dSpCas9-G1333-C | G | 0.07% | 99.92% | 0.02% | 0.09% | 2.67% | 0.06% | 0.00% | 0.02% |
| nogRNA-G1333spilt-KKH-Cas9-G1333-N and dSpCas9-G1333-C | N | 0.00% | 0.00% | 0.00% | 0.00% | 0.00% | 0.00% | 0.00% | 0.00% |
| nogRNA-G1333spilt-KKH-Cas9-G1333-N and dSpCas9-G1333-C | — | 0.02% | 0.06% | 0.02% | 97.19% | 97.21% | 97.40% | 99.98% | 99.98% |
| nogRNA-G1333spilt-KKH-Cas9-G1333-C and dSpCas9-G1333-N | A | 99.84% | 0.02% | 0.01% | 2.75% | 0.10% | 2.61% | 0.06% | 0.00% |
| nogRNA-G1333spilt-KKH-Cas9-G1333-C and dSpCas9-G1333-N | T | 0.02% | 0.00% | 0.04% | 0.00% | 0.01% | 0.00% | 0.00% | 0.00% |

TABLE 10C-continued

| | | No gRNA | | | | | | | |
|---|---|---|---|---|---|---|---|---|---|
| nogRNA-G1333spilt-KKH-Cas9-G1333-C and dSpCas9-G1333-N | C | 0.05% | 0.00% | 99.89% | 0.03% | 0.00% | 0.01% | 0.00% | 0.00% |
| nogRNA-G1333spilt-KKH-Cas9-G1333-C and dSpCas9-G1333-N | G | 0.08% | 99.95% | 0.01% | 0.10% | 2.77% | 0.05% | 0.00% | 0.05% |
| nogRNA-G1333spilt-KKH-Cas9-G1333-C and dSpCas9-G1333-N | N | 0.00% | 0.00% | 0.00% | 0.00% | 0.00% | 0.00% | 0.00% | 0.00% |
| nogRNA-G1333spilt-KKH-Cas9-G1333-C and dSpCas9-G1333-N | — | 0.02% | 0.03% | 0.04% | 97.12% | 97.13% | 97.33% | 99.94% | 99.95% |
| nogRNA-G1371spilt-KKH-Cas9-G1371-N and dSpCas9-G1371-C | A | 99.84% | 0.00% | 0.03% | 2.35% | 0.10% | 2.22% | 0.06% | 0.00% |
| nogRNA-G1371spilt-KKH-Cas9-G1371-N and dSpCas9-G1371-C | T | 0.02% | 0.00% | 0.03% | 0.01% | 0.00% | 0.00% | 0.00% | 0.00% |
| nogRNA-G1371spilt-KKH-Cas9-G1371-N and dSpCas9-G1371-C | C | 0.02% | 0.00% | 99.87% | 0.05% | 0.00% | 0.00% | 0.00% | 0.00% |
| nogRNA-G1371spilt-KKH-Cas9-G1371-N and dSpCas9-G1371-C | G | 0.07% | 99.95% | 0.03% | 0.11% | 2.38% | 0.06% | 0.00% | 0.06% |
| nogRNA-G1371spilt-KKH-Cas9-G1371-N and dSpCas9-G1371-C | N | 0.00% | 0.00% | 0.00% | 0.00% | 0.00% | 0.00% | 0.00% | 0.00% |
| nogRNA-G1371spilt-KKH-Cas9-G1371-N and dSpCas9-G1371-C | — | 0.04% | 0.05% | 0.04% | 97.48% | 97.51% | 97.72% | 99.94% | 99.94% |
| nogRNA-G1371spilt-KKH-Cas9-G1371-C and dSpCas9-G1371-N | A | 99.85% | 0.01% | 0.04% | 2.43% | 0.08% | 2.27% | 0.05% | 0.00% |
| nogRNA-G1371spilt-KKH-Cas9-G1371-C and dSpCas9-G1371-N | T | 0.01% | 0.01% | 0.07% | 0.01% | 0.01% | 0.00% | 0.00% | 0.00% |
| nogRNA-G1371spilt-KKH-Cas9-G1371-C and dSpCas9-G1371-N | C | 0.01% | 0.00% | 99.84% | 0.04% | 0.00% | 0.01% | 0.00% | 0.00% |
| nogRNA-G1371spilt-KKH-Cas9-G1371-C and dSpCas9-G1371-N | G | 0.09% | 99.93% | 0.03% | 0.10% | 2.45% | 0.05% | 0.00% | 0.06% |
| nogRNA-G1371spilt-KKH-Cas9-G1371-C and dSpCas9-G1371-N | N | 0.00% | 0.00% | 0.00% | 0.00% | 0.00% | 0.00% | 0.00% | 0.00% |
| nogRNA-G1371spilt-KKH-Cas9-G1371-C and dSpCas9-G1371-N | — | 0.03% | 0.05% | 0.02% | 97.43% | 97.46% | 97.66% | 99.94% | 99.94% |
| nogRNA-G1397spilt-KKH-Cas9-G1397-N and dSpCas9-G1397-C | A | 99.87% | 0.01% | 0.02% | 2.85% | 0.08% | 2.71% | 0.36% | 0.00% |
| nogRNA-G1397spilt-KKH-Cas9-G1397-N and dSpCas9-G1397-C | T | 0.00% | 0.00% | 0.04% | 0.02% | 0.01% | 0.00% | 0.00% | 0.00% |
| nogRNA-G1397spilt-KKH-Cas9-G1397-N and dSpCas9-G1397-C | C | 0.02% | 0.00% | 99.91% | 0.03% | 0.00% | 0.02% | 0.00% | 0.00% |
| nogRNA-G1397spilt-KKH-Cas9-G1397-N and dSpCas9-G1397-C | G | 0.09% | 99.94% | 0.02% | 0.09% | 2.87% | 0.05% | 0.00% | 0.36% |
| nogRNA-G1397spilt-KKH-Cas9-G1397-N and dSpCas9-G1397-C | N | 0.00% | 0.00% | 0.00% | 0.00% | 0.00% | 0.00% | 0.00% | 0.00% |
| nogRNA-G1397spilt-KKH-Cas9-G1397-N and dSpCas9-G1397-C | — | 0.01% | 0.05% | 0.01% | 97.01% | 97.04% | 97.23% | 99.64% | 99.64% |
| nogRNA-G1397spilt-KKH-Cas9-G1397-C and dSpCas9-G1397-N | A | 99.82% | 0.01% | 0.02% | 2.72% | 0.10% | 2.53% | 0.05% | 0.00% |
| nogRNA-G1397spilt-KKH-Cas9-G1397-C and dSpCas9-G1397-N | T | 0.01% | 0.00% | 0.02% | 0.01% | 0.01% | 0.01% | 0.00% | 0.00% |
| nogRNA-G1397spilt-KKH-Cas9-G1397-C and dSpCas9-G1397-N | C | 0.05% | 0.00% | 99.90% | 0.04% | 0.00% | 0.02% | 0.00% | 0.00% |
| nogRNA-G1397spilt-KKH-Cas9-G1397-C and dSpCas9-G1397-N | G | 0.07% | 99.93% | 0.02% | 0.09% | 2.72% | 0.08% | 0.00% | 0.05% |

TABLE 10C-continued

| No gRNA | | | | | | | | | |
|---|---|---|---|---|---|---|---|---|---|
| nogRNA-G1397spilt-KKH-Cas9-G1397-C and dSpCas9-G1397-N | N | 0.00% | 0.00% | 0.00% | 0.00% | 0.00% | 0.00% | 0.00% | 0.00% |
| nogRNA-G1397spilt-KKH-Cas9-G1397-C and dSpCas9-G1397-N | — | 0.05% | 0.06% | 0.04% | 97.14% | 97.17% | 97.35% | 99.95% | 99.95% |
| nogRNA-N1357spilt-KKH-Cas9-N1357-N and dSpCas9-N1357-C | A | 99.86% | 0.00% | 0.03% | 2.50% | 0.10% | 2.35% | 0.02% | 0.00% |
| nogRNA-N1357spilt-KKH-Cas9-N1357-N and dSpCas9-N1357-C | T | 0.01% | 0.01% | 0.05% | 0.01% | 0.00% | 0.01% | 0.00% | 0.00% |
| nogRNA-N1357spilt-KKH-Cas9-N1357-N and dSpCas9-N1357-C | C | 0.03% | 0.00% | 99.87% | 0.05% | 0.00% | 0.00% | 0.00% | 0.00% |
| nogRNA-N1357spilt-KKH-Cas9-N1357-N and dSpCas9-N1357-C | G | 0.09% | 99.95% | 0.01% | 0.13% | 2.57% | 0.05% | 0.00% | 0.02% |
| nogRNA-N1357spilt-KKH-Cas9-N1357-N and dSpCas9-N1357-C | N | 0.00% | 0.00% | 0.00% | 0.00% | 0.00% | 0.00% | 0.00% | 0.00% |
| nogRNA-N1357spilt-KKH-Cas9-N1357-N and dSpCas9-N1357-C | — | 0.02% | 0.03% | 0.03% | 97.31% | 97.33% | 97.59% | 99.98% | 99.98% |
| nogRNA-N1357spilt-KKH-Cas9-N1357-C and dSpCas9-N1357-N | A | 99.78% | 0.03% | 0.06% | 2.41% | 0.06% | 2.29% | 0.02% | 0.00% |
| nogRNA-N1357spilt-KKH-Cas9-N1357-C and dSpCas9-N1357-N | T | 0.01% | 0.01% | 0.03% | 0.02% | 0.01% | 0.01% | 0.00% | 0.00% |
| nogRNA-N1357spilt-KKH-Cas9-N1357-C and dSpCas9-N1357-N | C | 0.07% | 0.01% | 99.86% | 0.06% | 0.00% | 0.05% | 0.00% | 0.00% |
| nogRNA-N1357spilt-KKH-Cas9-N1357-C and dSpCas9-N1357-N | G | 0.08% | 99.90% | 0.03% | 0.05% | 2.45% | 0.04% | 0.00% | 0.02% |
| nogRNA-N1357spilt-KKH-Cas9-N1357-C and dSpCas9-N1357-N | N | 0.00% | 0.00% | 0.00% | 0.00% | 0.00% | 0.00% | 0.00% | 0.00% |
| nogRNA-N1357spilt-KKH-Cas9-N1357-C and dSpCas9-N1357-N | — | 0.06% | 0.06% | 0.02% | 97.46% | 97.48% | 97.62% | 99.98% | 99.98% |
| nogRNA-N1387spilt-KKH-Cas9-N1387-N and dSpCas9-N1387-C | A | 99.82% | 0.01% | 0.04% | 2.60% | 0.08% | 2.46% | 0.06% | 0.00% |
| nogRNA-N1387spilt-KKH-Cas9-N1387-N and dSpCas9-N1387-C | T | 0.01% | 0.03% | 0.03% | 0.00% | 0.01% | 0.00% | 0.00% | 0.00% |
| nogRNA-N1387spilt-KKH-Cas9-N1387-N and dSpCas9-N1387-C | C | 0.06% | 0.00% | 99.91% | 0.03% | 0.00% | 0.00% | 0.00% | 0.00% |
| nogRNA-N1387spilt-KKH-Cas9-N1387-N and dSpCas9-N1387-C | G | 0.08% | 99.92% | 0.01% | 0.12% | 2.64% | 0.05% | 0.00% | 0.06% |
| nogRNA-N1387spilt-KKH-Cas9-N1387-N and dSpCas9-N1387-C | N | 0.00% | 0.00% | 0.00% | 0.00% | 0.00% | 0.00% | 0.00% | 0.00% |
| nogRNA-N1387spilt-KKH-Cas9-N1387-N and dSpCas9-N1387-C | — | 0.03% | 0.04% | 0.01% | 97.24% | 97.27% | 97.48% | 99.94% | 99.94% |
| nogRNA-N1387spilt-KKH-Cas9-N1387-C and dSpCas9-N1387-N | A | 99.82% | 0.02% | 0.02% | 2.58% | 0.13% | 2.37% | 0.05% | 0.00% |
| nogRNA-N1387spilt-KKH-Cas9-N1387-C and dSpCas9-N1387-N | T | 0.01% | 0.00% | 0.04% | 0.00% | 0.01% | 0.00% | 0.00% | 0.00% |
| nogRNA-N1387spilt-KKH-Cas9-N1387-C and dSpCas9-N1387-N | C | 0.04% | 0.00% | 99.85% | 0.03% | 0.00% | 0.01% | 0.00% | 0.00% |
| nogRNA-N1387spilt-KKH-Cas9-N1387-C and dSpCas9-N1387-N | G | 0.11% | 99.93% | 0.02% | 0.13% | 2.57% | 0.08% | 0.00% | 0.05% |
| nogRNA-N1387spilt-KKH-Cas9-N1387-C and dSpCas9-N1387-N | N | 0.00% | 0.00% | 0.00% | 0.00% | 0.00% | 0.00% | 0.00% | 0.00% |

TABLE 10C-continued

| No gRNA | | | | | | | | | |
|---|---|---|---|---|---|---|---|---|---|
| nogRNA-N1387spilt-KKH-Cas9-N1387-C and dSpCas9-N1387-N | — | 0.02% | 0.04% | 0.06% | 97.27% | 97.29% | 97.53% | 99.94% | 99.95% |

Table 11 Shows Indel Frequencies

| Sample | Reads_aligned | Insertions | Deletions | indel % |
|---|---|---|---|---|
| ND5.1-DdCBE_replicate1 | 27776 | 0 | 4 | 0.014400922 |
| ND5.1-DdCBE_replicate2 | 35682 | 0 | 13 | 0.036432935 |
| ND5.1-DdCBE_replicate3 | 38221 | 0 | 7 | 0.018314539 |
| ND5.2-DdCBE_replicate1 | 75163 | 0 | 33 | 0.043904581 |
| ND5.2-DdCBE_replicate2 | 3150 | 0 | 1 | 0.031746032 |
| ND5.2-DdCBE_replicate3 | 100007 | 0 | 37 | 0.03699741 |
| ND5.3-DdCBE_replicate1 | 55241 | 0 | 10 | 0.018102496 |
| ND5.3-DdCBE_replicate2 | 64264 | 0 | 19 | 0.029565542 |
| ND5.3-DdCBE_replicate3 | 75963 | 0 | 18 | 0.023695747 |
| ND4-DdCBE_replicate1 | 96693 | 0 | 15 | 0.015513015 |
| ND4-DdCBE_replicate2 | 34406 | 0 | 9 | 0.026158228 |
| ND4-DdCBE_replicate3 | 67979 | 1 | 6 | 0.010297298 |
| ND2-DdCBE_replicate1 | 38026 | 0 | 8 | 0.021038237 |
| ND2-DdCBE_replicate2 | 42224 | 0 | 5 | 0.011841607 |
| ND2-DdCBE_replicate3 | 38272 | 0 | 7 | 0.018290134 |
| ND1-DdCBE_replicate1 | 3412 | 0 | 1 | 0.029308324 |
| ND1-DdCBE_replicate2 | 71984 | 0 | 13 | 0.018059569 |
| ND1-DdCBE_replicate3 | 27370 | 0 | 4 | 0.014614541 |
| BMATP8mito55mito56replicate1 | 46836 | 0 | 5 | 0.010675549 |
| BMATP8mito55mito56replicate2 | 47180 | 0 | 12 | 0.025434506 |
| BMATP8mito55mito56replicate3 | 50303 | 0 | 27 | 0.053674731 |
| untreated-day3_replicate1 | 50677 | 0 | 17 | 0.03354579 |
| untreated-day3_replicate2 | 81585 | 0 | 35 | 0.042900043 |
| untreated-day3_replicate3 | 70197 | 0 | 20 | 0.028491246 |
| untreated-day6_replicate1 | 96647 | 0 | 6 | 0.00620816 |
| untreated-day6_replicate2 | 35744 | 0 | 4 | 0.011190689 |
| untreated-day6_replicate3 | 57272 | 0 | 5 | 0.00873027 |

TABLE 12A

| Base Percentages at TALE Binding Sites-ND6-DdCBE | | | | | | | | | | | | | |
|---|---|---|---|---|---|---|---|---|---|---|---|---|---|
| Batch | Nucleotide | T | C | A | C | C | A | A | G | A | C | C | T |
| ND6-DdCBE_replicate1 | A | 0.01% | 0.01% | 99.94% | 0.01% | 0.01% | 99.94% | 99.93% | 0.09% | 99.95% | 0.02% | 0.01% | 0.01% |
| ND6-DdCBE_replicate1 | T | 99.92% | 0.23% | 0.01% | 0.03% | 0.02% | 0.01% | 0.00% | 0.02% | 0.00% | 0.03% | 0.01% | 99.96% |
| ND6-DdCBE_replicate1 | C | 0.07% | 99.76% | 0.04% | 99.94% | 99.96% | 0.03% | 0.04% | 0.00% | 0.03% | 99.95% | 99.99% | 0.02% |
| ND6-DdCBE_replicate1 | G | 0.00% | 0.00% | 0.02% | 0.01% | 0.01% | 0.02% | 0.03% | 99.89% | 0.02% | 0.00% | 0.00% | 0.01% |
| ND6-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate1 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | A | 0.01% | 0.01% | 99.95% | 0.01% | 0.00% | 99.96% | 99.94% | 0.15% | 99.95% | 0.00% | 0.01% | 0.00% |
| ND6-DdCBE_replicate2 | T | 99.90% | 0.21% | 0.01% | 0.02% | 0.02% | 0.01% | 0.00% | 0.02% | 0.02% | 0.03% | 0.00% | 99.99% |
| ND6-DdCBE_replicate2 | C | 0.09% | 99.78% | 0.03% | 99.97% | 99.97% | 0.03% | 0.05% | 0.00% | 0.02% | 99.97% | 99.99% | 0.01% |
| ND6-DdCBE_replicate2 | G | 0.00% | 0.00% | 0.01% | 0.00% | 0.00% | 0.01% | 0.01% | 99.83% | 0.01% | 0.00% | 0.00% | 0.00% |

TABLE 12A-continued

| | | | | | | | | | | | | | |
|---|---|---|---|---|---|---|---|---|---|---|---|---|---|
| ND6-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | A | 0.01% | 0.00% | 99.9% | 0.01% | 0.02% | 99.95% | 99.95% | 0.13% | 99.98% | 0.01% | 0.00% | 0.01% |
| ND6-DdCBE_replicate3 | T | 99.87% | 0.17% | 0.01% | 0.02% | 0.01% | 0.01% | 0.00% | 0.02% | 0.00% | 0.02% | 0.01% | 99.98% |
| ND6-DdCBE_replicate3 | C | 0.11% | 99.82% | 0.03% | 99.97% | 99.96% | 0.03% | 0.04% | 0.00% | 0.01% | 99.97% | 99.99% | 0.01% |
| ND6-DdCBE_replicate3 | G | 0.00% | 0.00% | 0.01% | 0.00% | 0.00% | 0.01% | 0.01% | 99.85% | 0.01% | 0.00% | 0.00% | 0.00% |
| ND6-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | — | 0.00% | 0.00% | 0.00% | 0.00% | 0.00% | 0.00% | 0.00% | 0.00% | 0.00% | 0.00% | 0.00% | 0.00% |

Base Percentages at TALE Binding Sites-ND6-DdCBE

| Batch | Nucleotide | C | A | A | C | C | C | C | T | G | A | C | C |
|---|---|---|---|---|---|---|---|---|---|---|---|---|---|
| ND6-DdCBE_replicate1 | A | 0.01% | 99.96% | 99.95% | 0.01% | 0.02% | 0.01% | 0.01% | 0.01% | 0.11% | 99.98% | 0.01% | 0.01% |
| ND6-DdCBE_replicate1 | T | 0.25% | 0.00% | 0.00% | 0.01% | 0.01% | 0.00% | 0.01% | 99.98% | 0.02% | 0.01% | 0.01% | 0.01% |
| ND6-DdCBE_replicate1 | C | 99.74% | 0.03% | 0.03% | 99.98% | 99.97% | 99.99% | 99.98% | 0.02% | 0.00% | 0.00% | 99.98% | 99.98% |
| ND6-DdCBE_replicate1 | G | 0.00% | 0.01% | 0.02% | 0.00% | 0.00% | 0.00% | 0.00% | 0.00% | 99.87% | 0.01% | 0.00% | 0.00% |
| ND6-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate1 | — | 0.00% | 0.00% | 0.00% | 0.00% | 0.00% | 0.00% | 0.01% | 0.00% | 0.00% | 0.00% | 0.00% | 0.00% |
| ND6-DdCBE_replicate2 | A | 0.00% | 99.96% | 99.96% | 0.00% | 0.01% | 0.01% | 0.01% | 0.01% | 0.14% | 99.97% | 0.01% | 0.00% |
| ND6-DdCBE_replicate2 | T | 0.19% | 0.00% | 0.00% | 0.00% | 0.00% | 0.01% | 0.01% | 99.97% | 0.01% | 0.01% | 0.01% | 0.01% |
| ND6-DdCBE_replicate2 | C | 99.80% | 0.02% | 0.02% | 99.99% | 99.98% | 99.98% | 99.98% | 0.02% | 0.00% | 0.01% | 99.98% | 99.98% |
| ND6-DdCBE_replicate2 | G | 0.00% | 0.01% | 0.02% | 0.00% | 0.00% | 0.00% | 0.00% | 0.00% | 99.84% | 0.01% | 0.00% | 0.00% |
| ND6-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | A | 0.00% | 99.97% | 99.96% | 0.01% | 0.01% | 0.01% | 0.01% | 0.00% | 0.07% | 99.98% | 0.01% | 0.00% |
| ND6-DdCBE_replicate3 | T | 0.18% | 0.00% | 0.00% | 0.01% | 0.01% | 0.01% | 0.01% | 99.97% | 0.01% | 0.01% | 0.01% | 0.01% |
| ND6-DdCBE_replicate3 | C | 99.81% | 0.02% | 0.02% | 99.98% | 99.98% | 99.99% | 99.98% | 0.02% | 0.00% | 0.01% | 99.98% | 99.99% |
| ND6-DdCBE_replicate3 | G | 0.00% | 0.01% | 0.01% | 0.00% | 0.00% | 0.00% | 0.00% | 0.00% | 99.92% | 0.01% | 0.00% | 0.00% |
| ND6-DdCBE_replicate3 | N | 0.00% | 0.00% | 0.00% | 0.00% | 0.00% | 0.00% | 0.00% | 0.00% | 0.00% | 0.00% | 0.00% | 0.00% |

TABLE 12A-continued

| | | | | | | | | | | | | | |
|---|---|---|---|---|---|---|---|---|---|---|---|---|---|
| ND6-DdCBE_replicate3 | — | 0.00% | 0.00% | 0.00% | 0.00% | 0.00% | 0.00% | 0.00% | 0.00% | 0.00% | 0.00% | 0.00% | 0.00% |

| Base Percentages at TALE Binding Sites-ND6-DdCBE | | | | | | | | | | | | | |
|---|---|---|---|---|---|---|---|---|---|---|---|---|---|
| Batch | Nucleotide | C | C | C | A | T | G | C | C | T | C | A | G |
| ND6-DdCBE_replicate1 | A | 0.01% | 0.02% | 0.00% | 99.97% | 0.00% | 0.02% | 0.01% | 0.00% | 0.01% | 0.00% | 99.96% | 30.47% |
| ND6-DdCBE_replicate1 | T | 0.01% | 0.02% | 0.01% | 0.00% | 99.99% | 0.00% | 0.03% | 0.00% | 99.98% | 0.17% | 0.00% | 0.01% |
| ND6-DdCBE_replicate1 | C | 99.98% | 99.96% | 99.97% | 0.01% | 0.01% | 0.01% | 99.96% | 99.99% | 0.01% | 99.82% | 0.02% | 0.03% |
| ND6-DdCBE_replicate1 | G | 0.01% | 0.00% | 0.00% | 0.01% | 0.00% | 99.97% | 0.00% | 0.00% | 0.00% | 0.00% | 0.02% | 69.49% |
| ND6-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate1 | — | 0.00% | 0.00% | 0.02% | 0.00% | 0.00% | 0.00% | 0.00% | 0.00% | 0.00% | 0.00% | 0.01% | 0.00% |
| ND6-DdCBE_replicate2 | A | 0.00% | 0.03% | 0.00% | 99.95% | 0.01% | 0.01% | 0.03% | 0.00% | 0.01% | 0.00% | 99.97% | 29.83% |
| ND6-DdCBE_replicate2 | T | 0.01% | 0.02% | 0.01% | 0.00% | 99.98% | 0.00% | 0.01% | 0.01% | 99.96% | 0.20% | 0.00% | 0.01% |
| ND6-DdCBE_replicate2 | C | 99.99% | 99.96% | 99.97% | 0.03% | 0.01% | 0.01% | 99.96% | 99.98% | 0.02% | 99.79% | 0.01% | 0.04% |
| ND6-DdCBE_replicate2 | G | 0.00% | 0.00% | 0.00% | 0.01% | 0.00% | 99.97% | 0.00% | 0.00% | 0.01% | 0.00% | 0.01% | 70.13% |
| ND6-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | | 0.00% | 0.00% | 0.01% | 0.00% | 0.00% | 0.00% | 0.00% | 0.00% | 0.00% | 0.00% | 0.00% | 0.00% |
| ND6-DdCBE_replicate3 | A | 0.00% | 0.02% | 0.01% | 99.96% | 0.01% | 0.01% | 0.02% | 0.01% | 0.00% | 0.01% | 99.97% | 26.86% |
| ND6-DdCBE_replicate3 | T | 0.01% | 0.01% | 0.01% | 0.01% | 99.98% | 0.01% | 0.02% | 0.01% | 99.96% | 0.15% | 0.01% | 0.01% |
| ND6-DdCBE_replicate3 | C | 99.99% | 99.97% | 99.96% | 0.02% | 0.01% | 0.01% | 99.96% | 99.99% | 0.03% | 99.84% | 0.01% | 0.03% |
| ND6-DdCBE_replicate3 | G | 0.00% | 0.00% | 0.00% | 0.01% | 0.00% | 99.97% | 0.00% | 0.00% | 0.01% | 0.00% | 0.02% | C |
| ND6-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | — | 0.00% | 0.00% | 0.02% | 0.00% | 0.00% | 0.00% | 0.00% | 0.00% | 0.00% | 0.00% | 0.00% | 0.00% |

| Base Percentages at TALE Binding Sites-ND6-DdCBE | | | | | | | | | | | | | |
|---|---|---|---|---|---|---|---|---|---|---|---|---|---|
| Batch | Nucleotide | G | A | T | A | C | T | C | C | T | C | A | A |
| ND6-DdCBE_replicate1 | A | 36.39% | 99.91% | 0.00% | 99.98% | 0.02% | 0.02% | 0.02% | 0.01% | 0.01% | 0.00% | 99.97% | 99.97% |
| ND6-DdCBE_replicate1 | T | 0.01% | 0.01% | 99.99% | 0.01% | 5.37% | 99.97% | 18.62% | 0.45% | 99.96% | 0.11% | 0.00% | 0.00% |
| ND6-DdCBE_replicate1 | C | 0.00% | 0.08% | 0.01% | 0.01% | 94.59% | 0.01% | 81.35% | 99.54% | 0.03% | 99.88% | 0.02% | 0.02% |
| ND6-DdCBE_replicate1 | G | 63.59% | 0.00% | 0.00% | 0.00% | 0.00% | 0.00% | 0.00% | 0.00% | 0.00% | 0.01% | 0.01% | 0.01% |

TABLE 12A-continued

| | | | | | | | | | | | | | |
|---|---|---|---|---|---|---|---|---|---|---|---|---|---|
| ND6-DdCBE_replicate1 | N | 0.00% | 0.00% | 0.00% | 0.00% | 0.01% | 0.00% | 0.00% | 0.00% | 0.00% | 0.00% | 0.00% | 0.00% |
| ND6-DdCBE_replicate1 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | A | 35.45% | 99.90% | 0.00% | 99.96% | 0.03% | 0.01% | 0.02% | 0.01% | 0.00% | 0.00% | 99.97% | 99.96% |
| ND6-DdCBE_replicate2 | T | 0.01% | 0.00% | 99.99% | 0.00% | 5.04% | 99.97% | 17.88% | 0.41% | 99.97% | 0.10% | 0.00% | 0.01% |
| ND6-DdCBE_replicate2 | C | 0.00% | 0.07% | 0.01% | 0.03% | 94.92% | 0.01% | 82.09% | 99.58% | 0.02% | 99.89% | 0.02% | 0.02% |
| ND6-DdCBE_replicate2 | G | 64.53% | 0.02% | 0.00% | 0.01% | 0.00% | 0.00% | 0.01% | 0.00% | 0.01% | 0.00% | 0.01% | 0.01% |
| ND6-DdCBE_replicate2 | N | 0.00% | 0.00% | 0.00% | 0.00% | 0.01% | 0.00% | 0.00% | 0.00% | 0.00% | 0.00% | 0.00% | 0.00% |
| ND6-DdCBE_replicate2 | | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | A | 31.97% | 99.89% | 0.01% | 99.96% | 0.03% | 0.02% | 0.02% | 0.00% | 0.01% | 0.00% | 99.97% | 99.96% |
| ND6-DdCBE_replicate3 | T | 0.01% | 0.01% | 99.97% | 0.01% | 4.50% | 99.96% | 15.39% | 0.34% | 99.98% | 0.08% | 0.00% | 0.01% |
| ND6-DdCBE_replicate3 | C | 0.00% | 0.09% | 0.02% | 0.03% | 95.46% | 0.02% | 84.59% | 99.65% | 0.01% | 99.91% | 0.01% | 0.02% |
| ND6-DdCBE_replicate3 | G | 68.02% | 0.02% | 0.00% | 0.01% | 0.00% | 0.00% | 0.00% | 0.00% | 0.00% | 0.00% | 0.01% | 0.01% |
| ND6-DdCBE_replicate3 | N | 0.00% | 0.00% | 0.00% | 0.00% | 0.01% | 0.00% | 0.00% | 0.00% | 0.00% | 0.00% | 0.00% | 0.00% |
| ND6-DdCBE_replicate3 | — | 0.00% | 0.00% | 0.00% | 0.00% | 0.00% | 0.00% | 0.00% | 0.00% | 0.00% | 0.00% | 0.00% | 0.00% |

Base Percentages at TALE Binding Sites-ND6-DdCBE

| Batch | Nucleotide | T | A | G | C | C | A | T | C | G | C | T | G |
|---|---|---|---|---|---|---|---|---|---|---|---|---|---|
| ND6-DdCBE_replicate1 | A | 0.01% | 99.95% | 0.02% | 0.01% | 0.02% | 99.96% | 0.01% | 0.07% | 0.02% | 0.01% | 0.00% | 0.01% |
| ND6-DdCBE_replicate | T | 99.97% | 0.01% | 0.02% | 0.01% | 0.02% | 0.01% | 99.98% | 0.25% | 0.03% | 0.01% | 99.97% | 0.02% |
| ND6-DdCBE_replicate1 | C | 0.01% | 0.03% | 0.01% | 99.99% | 99.96% | 0.02% | 0.01% | 99.69% | 0.01% | 99.98% | 0.03% | 0.01% |
| ND6-DdCBE_replicate1 | G | 0.02% | 0.01% | 99.96% | 0.00% | 0.01% | 0.01% | 0.00% | 0.00% | 99.94% | 0.00% | 0.00% | 99.97% |
| ND6-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate1 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | A | 0.01% | 99.97% | 0.03% | 0.00% | 0.02% | 99.98% | 0.01% | 0.07% | 0.01% | 0.01% | 0.00% | 0.01% |
| ND6-DdCBE_replicate2 | T | 99.96% | 0.01% | 0.02% | 0.01% | 0.02% | 0.00% | 99.97% | 0.23% | 0.02% | 0.01% | 99.97% | 0.02% |
| ND6-DdCBE_replicate2 | C | 0.01% | 0.02% | 0.02% | 99.98% | 99.96% | 0.01% | 0.02% | 99.71% | 0.01% | 99.98% | 0.02% | 0.00% |
| ND6-DdCBE_replicate2 | G | 0.01% | 0.01% | 99.94% | 0.00% | 0.00% | 0.01% | 0.00% | 0.00% | 99.96% | 0.00% | 0.01% | 99.97% |
| ND6-DdCBE_replicate2 | N | 0.00% | 0.00% | 0.00% | 0.00% | 0.00% | 0.00% | 0.00% | 0.00% | 0.00% | 0.00% | 0.00% | 0.00% |

TABLE 12A-continued

| | | | | | | | | | | | | | |
|---|---|---|---|---|---|---|---|---|---|---|---|---|---|
| ND6-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | A | 0.01% | 99.97% | 0.02% | 0.01% | 0.03% | 99.96% | 0.01% | 0.07% | 0.02% | 0.00% | 0.01% | 0.02% |
| ND6-DdCBE_replicate3 | T | 99.98% | 0.00% | 0.02% | 0.01% | 0.01% | 0.01% | 99.97% | 0.20% | 0.02% | 0.01% | 99.98% | 0.02% |
| ND6-DdCBE_replicate3 | C | 0.01% | 0.02% | 0.01% | 99.98% | 99.96% | 0.01% | 0.02% | 99.72% | 0.01% | 99.99% | 0.01% | 0.00% |
| ND6-DdCBE_replicate3 | G | 0.01% | 0.01% | 99.95% | 0.00% | 0.00% | 0.01% | 0.00% | 0.00% | 99.95% | 0.00% | 0.00% | 99.96% |
| ND6-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | — | 0.00% | 0.00% | 0.00% | 0.00% | 0.00% | 0.00% | 0.00% | 0.00% | 0.00% | 0.00% | 0.00% | 0.00% |

Base Percentages at TALE Binding Sites-ND6-DdCBE

| Batch | Nucleotide | T | A | G | T | A | T | A | T | C | C | A | A |
|---|---|---|---|---|---|---|---|---|---|---|---|---|---|
| ND6-DdCBE_replicate1 | A | 0.01% | 99.95% | 0.01% | 0.03% | 99.97% | 0.01% | 99.98% | 0.02% | 0.01% | 0.00% | 99.97% | 99.98% |
| ND6-DdCBE_replicate | T | 99.86% | 0.01% | 0.02% | 99.74% | 0.01% | 99.98% | 0.02% | 99.97% | 1.23% | 0.02% | 0.00% | 0.01% |
| ND6-DdCBE_replicate1 | C | 0.12% | 0.02% | 0.01% | 0.01% | 0.01% | 0.01% | 0.00% | 0.01% | 98.75% | 99.98% | 0.02% | 0.00% |
| ND6-DdCBE_replicate1 | G | 0.01% | 0.02% | 99.96% | 0.22% | 0.01% | 0.00% | 0.01% | 0.00% | 0.01% | 0.00% | 0.01% | 0.01% |
| ND6-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate1 | — | 0.00% | 0.00% | 0.00% | 0.00% | 0.00% | 0.00% | 0.00% | 0.00% | 0.00% | 0.01% | 0.00% | 0.00% |
| ND6-DdCBE_replicate2 | A | 0.02% | 99.96% | 0.02% | 0.03% | 99.98% | 0.01% | 99.98% | 0.02% | 0.01% | 0.01% | 99.95% | 99.98% |
| ND6-DdCBE_replicate2 | T | 99.86% | 0.01% | 0.02% | 99.75% | 0.00% | 99.98% | 0.01% | 99.96% | 1.21% | 0.03% | 0.00% | 0.01% |
| ND6-DdCBE_replicate2 | C | 0.11% | 0.01% | 0.00% | 0.02% | 0.01% | 0.01% | 0.00% | 0.02% | 98.78% | 99.96% | 0.02% | 0.01% |
| ND6-DdCBE_replicate2 | G | 0.01% | 0.02% | 99.96% | 0.20% | 0.01% | 0.00% | 0.01% | 0.00% | 0.00% | 0.00% | 0.02% | 0.01% |
| ND6-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | A | 0.01% | 99.96% | 0.01% | 0.02% | 99.97% | 0.00% | 99.98% | 0.01% | 0.01% | 0.01% | 99.97% | 99.99% |
| ND6-DdCBE_replicate3 | T | 99.91% | 0.01% | 0.03% | 99.76% | 0.01% | 99.99% | 0.01% | 99.97% | 0.98% | 0.02% | 0.01% | 0.00% |
| ND6-DdCBE_replicate3 | C | 0.08% | 0.02% | 0.00% | 0.02% | 0.01% | 0.00% | 0.01% | 0.01% | 99.01% | 99.9% | 0.01% | 0.00% |
| ND6-DdCBE_replicate3 | G | 0.00% | 0.02% | 99.96% | 0.21% | 0.01% | 0.00% | 0.00% | 0.00% | 0.00% | 0.00% | 0.01% | 0.00% |
| ND6-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND6-DdCBE_replicate3 | — | 0.00% | 0.00% | 0.00% | 0.00% | 0.00% | 0.00% | 0.00% | 0.00% | 0.00% | 0.00% | 0.00% | 0.00% |

TABLE 12A-continued

| Base Percentages at TALE Binding Sites-ND6-DdCBE | | | | | | |
|---|---|---|---|---|---|---|
| Batch | Nucleotide | A | G | A | C | A |
| ND6-DdCBE_replicate1 | A | 99.98% | 0.16% | 99.89% | 0.01% | 99.96% |
| ND6-DdCBE_replicate1 | T | 0.01% | 0.01% | 0.01% | 0.02% | 0.00% |
| ND6-DdCBE_replicate1 | C | 0.01% | 0.01% | 0.09% | 99.97% | 0.02% |
| ND6-DdCBE_replicate1 | G | 0.00% | 99.82% | 0.01% | 0.00% | 0.01% |
| ND6-DdCBE_replicate1 | N | 0.00% | 0.00% | 0.00% | 0.00% | 0.00% |
| ND6-DdCBE_replicate1 | — | 0.01% | 0.00% | 0.00% | 0.00% | 0.00% |
| ND6-DdCBE_replicate2 | A | 99.98% | 0.17% | 99.89% | 0.01% | 99.97% |
| ND6-DdCBE_replicate2 | T | 0.00% | 0.01% | 0.01% | 0.01% | 0.00% |
| ND6-DdCBE_replicate2 | C | 0.01% | 0.00% | 0.09% | 99.98% | 0.01% |
| ND6-DdCBE_replicate2 | G | 0.00% | 99.82% | 0.01% | 0.00% | 0.01% |
| ND6-DdCBE_replicate2 | N | 0.00% | 0.00% | 0.00% | 0.00% | 0.00% |
| ND6-DdCBE_replicate2 | — | 0.01% | 0.00% | 0.00% | 0.00% | 0.00% |
| ND6-DdCBE_replicate3 | A | 99.95% | 0.14% | 99.92% | 0.01% | 99.97% |
| ND6-DdCBE_replicate3 | T | 0.01% | 0.02% | 0.01% | 0.01% | 0.01% |
| ND6-DdCBE_replicate3 | C | 0.02% | 0.00% | 0.06% | 99.98% | 0.01% |
| ND6-DdCBE_replicate3 | G | 0.01% | 99.84% | 0.01% | 0.00% | 0.01% |
| ND6-DdCBE_replicate3 | N | 0.00% | 0.00% | 0.00% | 0.00% | 0.00% |
| ND6-DdCBE_replicate3 | — | 0.01% | 0.00% | 0.00% | 0.00% | 0.00% |

TABLE 12B

| Base Percentages at TALE Binding Sites-ND5.1-DdCBE | | | | | | | | | | | | | |
|---|---|---|---|---|---|---|---|---|---|---|---|---|---|
| Batch | Nucleotide | C | T | C | C | C | T | C | A | C | C | A | T |
| ND5.1-DdCBE_replicate 1 | A | 0.01% | 0.00% | 0.05% | 0.02% | 0.03% | 0.02% | 0.04% | 99.95% | 0.02% | 0.02% | 99.98% | 0.03% |
| ND5.1-DdCBE_replicate1 | T | 0.01% | 99.98% | 0.14% | 0.03% | 0.01% | 99.96% | 0.12% | 0.02% | 0.02% | 0.03% | 0.00% | 99.97% |
| ND5.1-DdCBE_replicate1 | C | 99.97% | 0.01% | 99.81% | 99.95% | 99.93% | 0.01% | 99.84% | 0.00% | 99.96% | 99.95% | 0.00% | 0.00% |

TABLE 12B-continued

| | | | | | | | | | | | | | |
|---|---|---|---|---|---|---|---|---|---|---|---|---|---|
| ND5.1-DdCBE_replicate1 | G | 0.00% | 0.00% | 0.00% | 0.00% | 0.01% | 0.00% | 0.00% | 0.03% | 0.00% | 0.00% | 0.01% | 0.00% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.00% | 0.00% | 0.02% | 0.00% | 0.00% | 0.00% | 0.00% | 0.00% | 0.00% | 0.00% |
| ND5.1-DdCBE_replicate2 | A | 0.01% | 0.01% | 0.06% | 0.01% | 0.04% | 0.01% | 0.01% | 99.95% | 0.01% | 0.01% | 99.96% | 0.01% |
| ND5.1-DdCBE_replicate2 | T | 0.01% | 99.95% | 0.14% | 0.03% | 0.02% | 99.97% | 0.14% | 0.02% | 0.01% | 0.03% | 0.02% | 99.96% |
| ND5.1-DdCBE_replicate2 | C | 99.98% | 0.04% | 99.79% | 99.96% | 99.92% | 0.02% | 99.84% | 0.01% | 99.97% | 99.96% | 0.00% | 0.03% |
| ND5.1-DdCBE_replicate2 | G | 0.01% | 0.00% | 0.00% | 0.00% | 0.01% | 0.00% | 0.00% | 0.02% | 0.00% | 0.00% | 0.01% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.00% | 0.00% | 0.00% | 0.00% | 0.02% | 0.00% | 0.00% | 0.01% | 0.01% | 0.00% | 0.00% | 0.00% |
| ND5.1-DdCBE_replicate3 | A | 0.01% | 0.01% | 0.06% | 0.01% | 0.03% | 0.01% | 0.06% | 99.96% | 0.02% | 0.01% | 99.97% | 0.01% |
| ND5.1-DdCBE_replicate3 | T | 0.02% | 99.96% | 0.09% | 0.03% | 0.02% | 99.97% | 0.08% | 0.02% | 0.04% | 0.03% | 0.02% | 99.98% |
| ND5.1-DdCBE_replicate3 | C | 99.97% | 0.03% | 99.85% | 99.95% | 99.92% | 0.02% | 99.86% | 0.01% | 99.94% | 99.96% | 0.00% | 0.01% |
| ND5.1-DdCBE_replicate3 | G | 0.00% | 0.00% | 0.00% | 0.01% | 0.00% | 0.00% | 0.00% | 0.02% | 0.00% | 0.00% | 0.00% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.00% | 0.00% | 0.02% | 0.00% | 0.00% | 0.00% | 0.00% | 0.00% | 0.00% | 0.00% |

Base Percentages at TALE Binding Sites-ND5.1-DdCBE

| Batch | Nucleotide | T | G | G | C | A | G | C | C | T | A | G | C |
|---|---|---|---|---|---|---|---|---|---|---|---|---|---|
| ND5.1-DdCBE_replicate 1 | A | 0.03% | 0.05% | 0.02% | 0.00% | 99.97% | 0.15% | 0.01% | 0.01% | 0.01% | 99.98% | 0.01% | 0.01% |
| ND5.1-DdCBE_replicate1 | T | 99.96% | 0.03% | 0.03% | 0.04% | 0.00% | 0.01% | 0.03% | 0.01% | 99.99% | 0.01% | 0.01% | 0.01% |
| ND5.1-DdCBE_replicate1 | C | 0.01% | 0.01% | 0.00% | 99.95% | 0.00% | 0.00% | 99.95% | 99.98% | 0.01% | 0.00% | 0.00% | 99.97% |
| ND5.1-DdCBE_replicate1 | G | 0.00% | 99.91% | 99.9% | 0.00% | 0.02% | 99.83% | 0.01% | 0.00% | 0.00% | 0.01% | 99.97% | 0.00% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.02% | 0.00% | 0.00% | 0.00% | 0.00% | 0.00% | 0.00% | 0.00% | 0.00% | 0.00% |
| ND5.1-DdCBE_replicate2 | A | 0.01% | 0.04% | 0.02% | 0.02% | 99.95% | 0.13% | 0.01% | 0.01% | 0.01% | 99.96% | 0.01% | 0.02% |
| ND5.1-DdCBE_replicate2 | T | 99.99% | 0.04% | 0.02% | 0.05% | 0.02% | 0.03% | 0.01% | 0.01% | 99.99% | 0.02% | 0.02% | 0.02% |
| ND5.1-DdCBE_replicate2 | C | 0.00% | 0.01% | 0.00% | 99.92% | 0.00% | 0.00% | 99.97% | 99.97% | 0.01% | 0.00% | 0.00% | 99.97% |

TABLE 12B-continued

| | | | | | | | | | | | | | |
|---|---|---|---|---|---|---|---|---|---|---|---|---|---|
| ND5.1-DdCBE_replicate2 | G | 0.00% | 99.91% | 99.96% | 0.00% | 0.03% | 99.84% | 0.00% | 0.00% | 0.00% | 0.02% | 99.97% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.00% | 0.00% | 0.01% | 0.00% | 0.00% | 0.00% | 0.00% | 0.00% | 0.00% | 0.00% | 0.00% | 0.00% |
| ND5.1-DdCBE_replicate3 | A | 0.03% | 0.05% | 0.02% | 0.01% | 99.93% | 0.18% | 0.01% | 0.02% | 0.01% | 99.96% | 0.01% | 0.02% |
| ND5.1-DdCBE_replicate3 | T | 99.94% | 0.03% | 0.04% | 0.08% | 0.03% | 0.02% | 0.02% | 0.01% | 99.96% | 0.02% | 0.01% | 0.02% |
| ND5.1-DdCBE_replicate3 | C | 0.03% | 0.00% | 0.00% | 99.90% | 0.00% | 0.00% | 99.97% | 99.97% | 0.02% | 0.00% | 0.01% | 99.96% |
| ND5.1-DdCBE_replicate3 | G | 0.00% | 99.92% | 99.93% | 0.01% | 0.04% | 99.80% | 0.00% | 0.00% | 0.00% | 0.02% | 99.97% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.01% | 0.00% | 0.00% | 0.00% | 0.00% | 0.00% | 0.00% | 0.00% | 0.00% | 0.00% |

Base Percentages at TALE Binding Sites-ND5.1-DdCBE

| Batch | Nucleotide | A | T | T | A | G | C | A | G | G | A | A | T |
|---|---|---|---|---|---|---|---|---|---|---|---|---|---|
| ND5.1-DdCBE_replicate 1 | A | 99.97% | 0.00% | 0.00% | 99.82% | 0.01% | 0.02% | 99.97% | 0.02% | 0.05% | 99.97% | 99.97% | 0.01% |
| ND5.1-DdCBE_replicate1 | T | 0.01% | 99.98% | 99.96% | 0.01% | 0.03% | 0.03% | 0.02% | 0.04% | 0.02% | 0.02% | 0.01% | 99.99% |
| ND5.1-DdCBE_replicate1 | C | 0.01% | 0.02% | 0.02% | 0.00% | 0.00% | 99.95% | 0.00% | 0.01% | 0.00% | 0.00% | 0.00% | 0.00% |
| ND5.1-DdCBE_replicate1 | G | 0.01% | 0.00% | 0.00% | 0.15% | 99.95% | 0.00% | 0.01% | 99.94% | 99.93% | 0.01% | 0.02% | 0.00% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.01% | 0.01% | 0.00% | 0.00% | 0.00% | 0.00% | 0.00% | 0.00% | 0.00% | 0.00% |
| ND5.1-DdCBE_replicate2 | A | 99.96% | 0.01% | 0.00% | 99.87% | 0.03% | 0.01% | 99.96% | 0.01% | 0.03% | 99.98% | 99.97% | 0.01% |
| ND5.1-DdCBE_replicate2 | T | 0.03% | 99.98% | 99.98% | 0.01% | 0.03% | 0.02% | 0.02% | 0.03% | 0.03% | 0.00% | 0.01% | 99.97% |
| ND5.1-DdCBE_replicate2 | C | 0.00% | 0.01% | 0.02% | 0.00% | 0.00% | 99.97% | 0.01% | 0.01% | 0.00% | 0.01% | 0.00% | 0.02% |
| ND5.1-DdCBE_replicate2 | G | 0.01% | 0.00% | 0.00% | 0.12% | 99.94% | 0.01% | 0.02% | 99.95% | 99.94% | 0.01% | 0.02% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | A | 99.98% | 0.01% | 0.01% | 99.79% | 0.02% | 0.01% | 99.94% | 0.01% | 0.03% | 99.94% | 99.95% | 0.01% |
| ND5.1-DdCBE_replicate3 | T | 0.01% | 99.99% | 99.97% | 0.02% | 0.05% | 0.03% | 0.02% | 0.04% | 0.04% | 0.04% | 0.02% | 99.97% |
| ND5.1-DdCBE_replicate3 | C | 0.00% | 0.01% | 0.02% | 0.00% | 0.01% | 99.96% | 0.01% | 0.00% | 0.01% | 0.01% | 0.00% | 0.02% |

TABLE 12B-continued

| | | | | | | | | | | | | | |
|---|---|---|---|---|---|---|---|---|---|---|---|---|---|
| ND5.1-DdCBE_replicate3 | G | 0.02% | 0.00% | 0.00% | 0.18% | 99.92% | 0.00% | 0.03% | 99.95% | 99.92% | 0.02% | 0.03% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.00% | 0.01% | 0.00% | 0.00% | 0.00% | 0.00% | 0.00% | 0.00% | 0.00% | 0.00% |

Base Percentages at TALE Binding Sites-ND5.1-DdCBE

| Batch | Nu-cle-otide | A | C | C | T | T | T | C | C | T | C | A | C |
|---|---|---|---|---|---|---|---|---|---|---|---|---|---|
| ND5.1-DdCBE_replicate 1 | A | 99.96% | 0.00% | 0.01% | 0.01% | 0.01% | 0.00% | 0.01% | 0.01% | 0.01% | 0.02% | 99.97% | 0.01% |
| ND5.1-DdCBE_replicate1 | T | 0.03% | 0.03% | 0.01% | 99.81% | 99.97% | 99.97% | 0.16% | 0.05% | 99.98% | 47.95% | 0.01% | 1.14% |
| ND5.1-DdCBE_replicate1 | C | 0.00% | 99.96% | 99.97% | 0.18% | 0.03% | 0.03% | 99.82% | 99.94% | 0.01% | 52.03% | 0.00% | 98.85% |
| ND5.1-DdCBE_replicate1 | G | 0.01% | 0.00% | 0.00% | 0.00% | 0.00% | 0.00% | 0.00% | 0.00% | 0.00% | 0.00% | 0.01% | 0.00% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | A | 99.94% | 0.00% | 0.01% | 0.02% | 0.00% | 0.01% | 0.01% | 0.01% | 0.01% | 0.01% | 99.98% | 0.02% |
| ND5.1-DdCBE_replicate2 | T | 0.03% | 0.03% | 0.02% | 99.84% | 99.97% | 99.94% | 0.24% | 0.04% | 99.96% | 47.91% | 0.00% | 1.36% |
| ND5.1-DdCBE_replicate2 | C | 0.00% | 99.97% | 99.97% | 0.13% | 0.01% | 0.03% | 99.73% | 99.94% | 0.02% | 52.07% | 0.00% | 98.61% |
| ND5.1-DdCBE_replicate2 | G | 0.03% | 0.00% | 0.00% | 0.01% | 0.01% | 0.00% | 0.01% | 0.00% | 0.00% | 0.00% | 0.01% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.00% | 0.00% | 0.00% | 0.00% | 0.00% | 0.01% | 0.00% | 0.00% | 0.01% | 0.01% | 0.00% | 0.01% |
| ND5.1-DdCBE_replicate3 | A | 99.95% | 0.01% | 0.02% | 0.01% | 0.01% | 0.02% | 0.01% | 0.02% | 0.01% | 0.02% | 99.95% | 0.02% |
| ND5.1-DdCBE_replicate3 | T | 0.02% | 0.03% | 0.02% | 99.80% | 99.96% | 99.96% | 0.13% | 0.06% | 99.97% | 43.61% | 0.01% | 1.03% |
| ND5.1-DdCBE_replicate3 | C | 0.01% | 99.96% | 99.96% | 0.19% | 0.03% | 0.02% | 99.86% | 99.92% | 0.02% | 56.36% | 0.01% | 98.95% |
| ND5.1-DdCBE_replicate3 | G | 0.02% | 0.00% | 0.00% | 0.00% | 0.00% | 0.00% | 0.00% | 0.00% | 0.00% | 0.00% | 0.03% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.00% | 0.00% | 0.00% | 0.00% | 0.00% | 0.00% | 0.00% | 0.01% | 0.00% | 0.01% |

Base Percentages at TALE Binding Sites-ND5.1-DdCBE

| Batch | Nu-cle-otide | A | G | G | T | T | T | C | T | A | C | T | C |
|---|---|---|---|---|---|---|---|---|---|---|---|---|---|
| ND5.1-DdCBE_replicate 1 | A | 99.97% | 0.00% | 0.02% | 0.02% | 0.00% | 0.00% | 0.01% | 0.01% | 99.95% | 0.01% | 0.01% | 0.01% |

TABLE 12B-continued

| | | | | | | | | | | | | | |
|---|---|---|---|---|---|---|---|---|---|---|---|---|---|
| ND5.1-DdCBE_replicate1 | T | 0.01% | 0.02% | 0.01% | 99.82% | 99.97% | 99.99% | 0.03% | 99.98% | 0.02% | 0.04% | 99.97% | 0.03% |
| ND5.1-DdCBE_replicate1 | C | 0.00% | 0.00% | 0.00% | 0.09% | 0.02% | 0.00% | 99.96% | 0.01% | 0.01% | 99.95% | 0.01% | 99.95% |
| ND5.1-DdCBE_replicate1 | G | 0.02% | 99.98% | 99.96% | 0.07% | 0.00% | 0.00% | 0.00% | 0.00% | 0.02% | 0.00% | 0.00% | 0.01% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | A | 99.96% | 0.00% | 0.01% | 0.02% | 0.00% | 0.01% | 0.02% | 0.01% | 99.97% | 0.01% | 0.00% | 0.01% |
| ND5.1-DdCBE_replicate2 | T | 0.01% | 0.03% | 0.02% | 99.79% | 99.97% | 99.97% | 0.02% | 99.98% | 0.02% | 0.02% | 99.96% | 0.02% |
| ND5.1-DdCBE_replicate2 | C | 0.01% | 0.00% | 0.00% | 0.12% | 0.02% | 0.01% | 99.96% | 0.01% | 0.00% | 99.97% | 0.04% | 99.96% |
| ND5.1-DdCBE_replicate2 | G | 0.02% | 99.97% | 99.97% | 0.08% | 0.00% | 0.00% | 0.00% | 0.00% | 0.01% | 0.00% | 0.00% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.01% | 0.00% | 0.00% | 0.00% | 0.00% | 0.00% | 0.00% | 0.00% | 0.00% | 0.00% | 0.00% | 0.00% |
| ND5.1-DdCBE_replicate3 | A | 99.96% | 0.01% | 0.01% | 0.02% | 0.01% | 0.02% | 0.01% | 0.01% | 99.96% | 0.01% | 0.02% | 0.02% |
| ND5.1-DdCBE_replicate3 | T | 0.02% | 0.02% | 0.00% | 99.81% | 99.98% | 99.96% | 0.03% | 99.96% | 0.02% | 0.02% | 99.96% | 0.02% |
| ND5.1-DdCBE_replicate3 | C | 0.00% | 0.00% | 0.00% | 0.12% | 0.01% | 0.02% | 99.96% | 0.02% | 0.01% | 99.96% | 0.02% | 99.96% |
| ND5.1-DdCBE_replicate3 | G | 0.02% | 99.97% | 99.99% | 0.05% | 0.00% | 0.00% | 0.00% | 0.01% | 0.01% | 0.00% | 0.00% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.01% | 0.00% | 0.00% | 0.00% | 0.00% | 0.01% | 0.00% | 0.00% | 0.00% | 0.00% | 0.00% | 0.00% |

Base Percentages at TALE Binding Sites-ND5.1-DdCBE

| Batch | Nucleotide | C | A | A | A | G | A | C | C | A | C | A | T | C |
|---|---|---|---|---|---|---|---|---|---|---|---|---|---|---|
| ND5.1-DdCBE_replicate 1 | A | 0.08% | 99.95% | 99.98% | 99.94% | 0.03% | 99.98% | 0.02% | 0.03% | 99.95% | 0.01% | 99.98% | 0.03% | 0.03% |
| ND5.1-DdCBE_replicate1 | T | 0.03% | 0.01% | 0.01% | 0.00% | 0.04% | 0.01% | 0.02% | 0.02% | 0.01% | 0.03% | 0.01% | 99.95% | 0.14% |
| ND5.1-DdCBE_replicate1 | C | 99.87% | 0.01% | 0.00% | 0.01% | 0.00% | 0.00% | 99.96% | 99.95% | 0.01% | 99.96% | 0.00% | 0.02% | 99.82% |
| ND5.1-DdCBE_replicate1 | G | 0.01% | 0.03% | 0.01% | 0.03% | 99.94% | 0.01% | 0.00% | 0.00% | 0.03% | 0.01% | 0.00% | 0.00% | 0.00% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.00% | 0.01% | 0.00% | 0.00% | 0.00% | 0.00% | 0.00% | 0.00% | 0.00% | 0.00% | 0.00% |
| ND5.1-DdCBE_replicate2 | A | 0.09% | 99.94% | 99.98% | 99.93% | 0.02% | 99.97% | 0.01% | 0.03% | 99.96% | 0.01% | 99.97% | 0.02% | 0.02% |

TABLE 12B-continued

| | | | | | | | | | | | | | | |
|---|---|---|---|---|---|---|---|---|---|---|---|---|---|---|
| ND5.1-DdCBE_replicate2 | T | 0.03% | 0.01% | 0.01% | 0.00% | 0.03% | 0.01% | 0.01% | 0.01% | 0.03% | 0.02% | 0.01% | 99.96% | 0.17% |
| ND5.1-DdCBE_replicate2 | C | 99.87% | 0.03% | 0.00% | 0.00% | 0.01% | 0.01% | 99.98% | 99.96% | 0.01% | 99.96% | 0.00% | 0.01% | 99.81% |
| ND5.1-DdCBE_replicate2 | G | 0.01% | 0.02% | 0.01% | 0.03% | 99.94% | 0.01% | 0.00% | 0.01% | 0.01% | 0.00% | 0.02% | 0.00% | 0.00% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.01% | 0.00% | 0.00% | 0.04% | 0.00% | 0.00% | 0.00% | 0.00% | 0.00% | 0.01% | 0.01% | 0.00% | 0.00% |
| ND5.1-DdCBE_replicate3 | A | 0.09% | 99.96% | 99.99% | 99.94% | 0.03% | 99.96% | 0.00% | 0.04% | 99.96% | 0.02% | 99.97% | 0.02% | 0.02% |
| ND5.1-DdCBE_replicate3 | T | 0.03% | 0.00% | 0.00% | 0.01% | 0.01% | 0.03% | 0.01% | 0.02% | 0.03% | 0.01% | 0.01% | 99.96% | 0.11% |
| ND5.1-DdCBE_replicate3 | C | 99.87% | 0.02% | 0.00% | 0.01% | 0.01% | 0.01% | 99.99% | 99.93% | 0.00% | 99.97% | 0.01% | 0.02% | 99.87% |
| ND5.1-DdCBE_replicate3 | G | 0.01% | 0.02% | 0.01% | 0.03% | 99.95% | 0.01% | 0.00% | 0.00% | 0.02% | 0.00% | 0.01% | 0.00% | 0.00% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.00% | 0.02% | 0.00% | 0.00% | 0.00% | 0.01% | 0.00% | 0.00% | 0.00% | 0.00% | 0.00% |

Base Percentages at TALE Binding Sites-ND5.1-DdCBE

| Batch | Nucle-otide | A | T | C | G | A | A | A | C | C | G | C | A | A |
|---|---|---|---|---|---|---|---|---|---|---|---|---|---|---|
| ND5.1-DdCBE_replicate 1 | A | 99.97% | 0.01% | 0.01% | 0.05% | 99.95% | 99.98% | 99.98% | 0.01% | 0.01% | 0.05% | 0.01% | 99.96% | 99.98% |
| ND5.1-DdCBE_replicate1 | T | 0.01% | 99.97% | 0.12% | 0.01% | 0.01% | 0.00% | 0.01% | 0.01% | 0.01% | 0.03% | 0.03% | 0.00% | 0.00% |
| ND5.1-DdCBE_replicate1 | C | 0.01% | 0.02% | 99.86% | 0.00% | 0.00% | 0.01% | 0.01% | 99.97% | 99.97% | 0.01% | 99.96% | 0.01% | 0.00% |
| ND5.1-DdCBE_replicate1 | G | 0.01% | 0.00% | 0.01% | 99.93% | 0.03% | 0.01% | 0.00% | 0.00% | 0.00% | 99.91% | 0.00% | 0.03% | 0.01% |
| ND5.1-DdCBE_replicate 1 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate 1 | — | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | A | 99.98% | 0.02% | 0.01% | 0.05% | 99.98% | 99.97% | 99.97% | 0.01% | 0.02% | 0.07% | 0.01% | 99.97% | 99.97% |
| ND5.1-DdCBE_replicate2 | T | 0.01% | 99.97% | 0.12% | 0.03% | 0.01% | 0.00% | 0.01% | 0.01% | 0.02% | 0.02% | 0.03% | 0.01% | 0.01% |
| ND5.1-DdCBE_replicate2 | C | 0.00% | 0.01% | 99.86% | 0.00% | 0.00% | 0.01% | 0.01% | 99.97% | 99.96% | 0.01% | 99.96% | 0.01% | 0.00% |
| ND5.1-DdCBE_replicate2 | G | 0.01% | 0.00% | 0.01% | 99.92% | 0.01% | 0.02% | 0.02% | 0.00% | 0.00% | 99.90% | 0.00% | 0.01% | 0.02% |
| ND5.1-DdCBE_replicate2 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate2 | — | 0.00% | 0.00% | 0.00% | 0.00% | 0.00% | 0.00% | 0.01% | 0.00% | 0.00% | 0.00% | 0.00% | 0.00% | 0.00% |
| ND5.1-DdCBE_replicate3 | A | 99.96% | 0.01% | 0.02% | 0.07% | 99.96% | 99.97% | 99.95% | 0.01% | 0.02% | 0.04% | 0.01% | 99.94% | 99.97% |

TABLE 12B-continued

| | | | | | | | | | | | | | | |
|---|---|---|---|---|---|---|---|---|---|---|---|---|---|---|
| ND5.1-DdCBE_replicate3 | T | 0.02% | 99.98% | 0.14% | 0.02% | 0.02% | 0.01% | 0.01% | 0.02% | 0.02% | 0.02% | 0.02% | 0.02% | 0.01% |
| ND5.1-DdCBE_replicate3 | C | 0.00% | 0.01% | 99.83% | 0.00% | 0.00% | 0.00% | 0.03% | 99.98% | 99.95% | 0.01% | 99.97% | 0.01% | 0.01% |
| ND5.1-DdCBE_replicate3 | G | 0.02% | 0.00% | 0.01% | 99.90% | 0.01% | 0.02% | 0.01% | 0.00% | 0.01% | 99.93% | 0.01% | 0.04% | 0.01% |
| ND5.1-DdCBE_replicate3 | N | 0.00% | 0.00% | 0.00% | 0.00% | 0.00% | 0.00% | 0.00% | 0.00% | 0.00% | 0.00% | 0.00% | 0.00% | 0.00% |
| ND5.1-DdCBE_replicate3 | — | 0.00% | 0.00% | 0.00% | 0.00% | 0.00% | 0.00% | 0.00% | 0.00% | 0.00% | 0.00% | 0.00% | 0.00% | 0.00% |

TABLE 12C

| Base Percentages at TALE Binding Sites-ND5.2-DdCBE | | | | | | | | | | | | | |
|---|---|---|---|---|---|---|---|---|---|---|---|---|---|
| Batch | Nucleotide | T | C | G | A | A | A | A | A | T | A | G | G |
| ND5.2-DdCBE_replicate1 | A | 0.01% | 0.08% | 0.02% | 99.94% | 99.97% | 99.97% | 99.98% | 99.96% | 0.00% | 99.96% | 0.02% | 0.03% |
| ND5.2-DdCBE_replicate1 | T | 99.96% | 0.02% | 0.02% | 0.00% | 0.01% | 0.01% | 0.01% | 0.01% | 99.98% | 0.02% | 0.03% | 0.03% |
| ND5.2-DdCBE_replicate 1 | C | 0.01% | 99.88% | 0.00% | 0.05% | 0.01% | 0.01% | 0.00% | 0.01% | 0.01% | 0.01% | 0.00% | 0.01% |
| ND5.2-DdCBE_replicate1 | G | 0.01% | 0.00% | 99.96% | 0.01% | 0.01% | 0.01% | 0.01% | 0.01% | 0.00% | 0.01% | 99.95% | 99.92% |
| ND5.2-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate1 | — | 0.00% | 0.01% | 0.00% | 0.00% | 0.00% | 0.00% | 0.00% | 0.02% | 0.00% | 0.00% | 0.00% | 0.00% |
| ND5.2-DdCBE_replicate2 | A | 0.00% | 0.06% | 0.03% | 99.94% | 99.87% | 99.94% | 99.90% | 99.87% | 0.00% | 99.94% | 0.00% | 0.03% |
| ND5.2-DdCBE_replicate2 | T | 99.94% | 0.00% | 0.03% | 0.03% | 0.00% | 0.03% | 0.03% | 0.00% | 99.94% | 0.03% | 0.03% | 0.06% |
| ND5.2-DdCBE_replicate2 | C | 0.06% | 99.94% | 0.00% | 0.03% | 0.06% | 0.03% | 0.03% | 0.03% | 0.06% | 0.03% | 0.00% | 0.03% |
| ND5.2-DdCBE_replicate2 | G | 0.00% | 0.00% | 99.90% | 0.00% | 0.06% | 0.00% | 0.03% | 0.00% | 0.00% | 0.00% | 99.97% | 99.87% |
| ND5.2-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | | 0.00% | 0.00% | 0.03% | 0.00% | 0.00% | 0.00% | 0.00% | 0.10% | 0.00% | 0.00% | 0.00% | 0.00% |
| ND5.2-DdCBE_replicate3 | A | 0.01% | 0.07% | 0.01% | 99.91% | 99.97% | 99.97% | 99.97% | 99.96% | 0.00% | 99.97% | 0.02% | 0.02% |
| ND5.2-DdCBE_replicate3 | T | 99.97% | 0.02% | 0.02% | 0.00% | 0.01% | 0.01% | 0.01% | 0.01% | 99.99% | 0.01% | 0.03% | 0.02% |
| ND5.2-DdCBE_replicate3 | C | 0.01% | 99.90% | 0.00% | 0.07% | 0.01% | 0.01% | 0.01% | 0.01% | 0.01% | 0.01% | 0.00% | 0.01% |
| ND5.2-DdCBE_replicate3 | G | 0.01% | 0.00% | 99.96% | 0.02% | 0.01% | 0.01% | 0.01% | 0.01% | 0.00% | 0.00% | 99.95% | 99.95% |
| ND5.2-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | — | 0.00% | 0.01% | 0.00% | 0.00% | 0.00% | 0.00% | 0.00% | 0.01% | 0.00% | 0.00% | 0.00% | 0.00% |

TABLE 12C-continued

Base Percentages at TALE Binding Sites-ND5.2-DdCBE

| Batch | Nucleotide | A | G | G | A | C | T | A | C | T | C | A | A |
|---|---|---|---|---|---|---|---|---|---|---|---|---|---|
| ND5.2-DdCBE_replicate1 | A | 99.94% | 0.01% | 0.03% | 99.91% | 0.09% | 0.01% | 99.96% | 0.03% | 0.01% | 0.03% | 99.96% | 99.96% |
| ND5.2-DdCBE_replicate1 | T | 0.01% | 0.02% | 0.04% | 0.01% | 0.02% | 99.97% | 0.02% | 0.01% | 99.97% | 0.02% | 0.01% | 0.01% |
| ND5.2-DdCBE_replicate 1 | C | 0.03% | 0.00% | 0.01% | 0.05% | 99.89% | 0.01% | 0.01% | 99.96% | 0.01% | 99.95% | 0.02% | 0.03% |
| ND5.2-DdCBE_replicate1 | G | 0.02% | 99.96% | 99.91% | 0.03% | 0.00% | 0.01% | 0.01% | 0.00% | 0.00% | 0.01% | 0.01% | 0.00% |
| ND5.2-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate1 | — | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | A | 99.84% | 0.00% | 0.00% | 99.87% | 0.03% | 0.00% | 99.90% | 0.03% | 0.00% | 0.00% | 99.97% | 99.97% |
| ND5.2-DdCBE_replicate2 | T | 0.03% | 0.03% | 0.06% | 0.00% | 0.00% | 99.87% | 0.03% | 0.06% | 99.97% | 0.06% | 0.00% | 0.00% |
| ND5.2-DdCBE_replicate2 | C | 0.10% | 0.00% | 0.00% | 0.06% | 99.97% | 0.03% | 0.06% | 99.90% | 0.03% | 99.94% | 0.03% | 0.03% |
| ND5.2-DdCBE_replicate2 | G | 0.03% | 99.97% | 99.94% | 0.06% | 0.00% | 0.10% | 0.00% | 0.00% | 0.00% | 0.00% | 0.00% | 0.00% |
| ND5.2-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | A | 99.95% | 0.01% | 0.03% | 99.92% | 0.09% | 0.01% | 99.96% | 0.04% | 0.01% | 0.02% | 99.96% | 99.95% |
| ND5.2-DdCBE_replicate3 | T | 0.01% | 0.02% | 0.03% | 0.01% | 0.01% | 99.96% | 0.02% | 0.01% | 99.98% | 0.03% | 0.01% | 0.01% |
| ND5.2-DdCBE_replicate3 | C | 0.03% | 0.00% | 0.00% | 0.05% | 99.90% | 0.01% | 0.02% | 99.95% | 0.01% | 99.94% | 0.02% | 0.03% |
| ND5.2-DdCBE_replicate3 | G | 0.01% | 99.97% | 99.93% | 0.02% | 0.00% | 0.01% | 0.01% | 0.00% | 0.00% | 0.00% | 0.01% | 0.01% |
| ND5.2-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | — | 0.00% | 0.00% | 0.00% | 0.00% | 0.00% | 0.00% | 0.00% | 0.00% | 0.00% | 0.00% | 0.00% | 0.00% |

Base Percentages at TALE Binding Sites-ND5.2-DdCBE

| Batch | Nucleotide | A | A | C | C | A | T | A | C | C | T | C | T |
|---|---|---|---|---|---|---|---|---|---|---|---|---|---|
| ND5.2-DdCBE_replicate1 | A | 99.94% | 99.95% | 0.17% | 0.45% | 99.93% | 0.02% | 99.91% | 0.41% | 0.22% | 0.03% | 0.11% | 0.02% |
| ND5.2-DdCBE_replicate1 | T | 0.01% | 0.02% | 0.11% | 0.13% | 0.01% | 99.96% | 0.02% | 0.61% | 0.15% | 99.94% | 0.03% | 99.95% |
| ND5.2-DdCBE_replicate 1 | C | 0.04% | 0.02% | 99.71% | 99.41% | 0.04% | 0.02% | 0.04% | 98.96% | 99.61% | 0.01% | 99.85% | 0.02% |
| ND5.2-DdCBE_replicate1 | G | 0.02% | 0.01% | 0.01% | 0.00% | 0.02% | 0.00% | 0.04% | 0.02% | 0.03% | 0.01% | 0.01% | 0.01% |
| ND5.2-DdCBE_replicate1 | N | 0.00% | 0.00% | 0.00% | 0.00% | 0.00% | 0.00% | 0.00% | 0.00% | 0.00% | 0.00% | 0.00% | 0.00% |

TABLE 12C-continued

| | | | | | | | | | | | | | |
|---|---|---|---|---|---|---|---|---|---|---|---|---|---|
| ND5.2-DdCBE_replicate1 | — | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | A | 99.97% | 99.97% | 0.16% | 0.54% | 99.94% | 0.00% | 99.84% | 0.32% | 0.10% | 0.06% | 0.06% | 0.06% |
| ND5.2-DdCBE_replicate2 | T | 0.00% | 0.00% | 0.06% | 0.10% | 0.00% | 99.97% | 0.03% | 0.48% | 0.13% | 99.90% | 0.03% | 99.90% |
| ND5.2-DdCBE_replicate2 | C | 0.03% | 0.03% | 99.78% | 99.37% | 0.03% | 0.03% | 0.06% | 99.21% | 99.78% | 0.00% | 99.90% | 0.03% |
| ND5.2-DdCBE_replicate2 | G | 0.00% | 0.00% | 0.00% | 0.00% | 0.03% | 0.00% | 0.06% | 0.00% | 0.00% | 0.03% | 0.00% | 0.00% |
| ND5.2-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | — | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | A | 99.95% | 99.97% | 0.16% | 0.40% | 99.95% | 0.01% | 99.94% | 0.38% | 0.19% | 0.04% | 0.12% | 0.02% |
| ND5.2-DdCBE_replicate3 | T | 0.00% | 0.01% | 0.10% | 0.07% | 0.01% | 99.98% | 0.01% | 0.46% | 0.11% | 99.94% | 0.03% | 99.95% |
| ND5.2-DdCBE_replicate3 | C | 0.02% | 0.01% | 99.74% | 99.53% | 0.03% | 0.01% | 0.02% | 99.14% | 99.67% | 0.01% | 99.84% | 0.02% |
| ND5.2-DdCBE_replicate3 | G | 0.02% | 0.01% | 0.00% | 0.00% | 0.01% | 0.00% | 0.02% | 0.01% | 0.03% | 0.00% | 0.00% | 0.01% |
| ND5.2-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | — | 0.00% | 0.01% | 0.00% | 0.00% | 0.00% | 0.00% | 0.00% | 0.00% | 0.00% | 0.00% | 0.00% | 0.00% |

| Base Percentages at TALE Binding Sites-ND5.2-DdCBE | | | | | | | | | | | | | |
|---|---|---|---|---|---|---|---|---|---|---|---|---|---|
| Batch | Nucleotide | C | A | C | T | T | C | A | A | C | C | T | C |
| ND5.2-DdCBE_replicate1 | A | 0.04% | 99.95% | 0.07% | 0.01% | 0.01% | 0.15% | 99.95% | 99.95% | 0.04% | 0.04% | 0.01% | 0.05% |
| ND5.2-DdCBE_replicate1 | T | 0.15% | 0.01% | 0.03% | 99.97% | 99.97% | 0.05% | 0.01% | 0.01% | 0.03% | 0.03% | 99.97% | 7.13% |
| ND5.2-DdCBE_replicate 1 | C | 99.81% | 0.03% | 99.89% | 0.02% | 0.02% | 99.78% | 0.02% | 0.02% | 99.85% | 99.91% | 0.01% | 92.81% |
| ND5.2-DdCBE_replicate1 | G | 0.01% | 0.01% | 0.00% | 0.00% | 0.01% | 0.01% | 0.01% | 0.01% | 0.08% | 0.01% | 0.01% | 0.01% |
| ND5.2-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate1 | — | 0.00% | 0.00% | 0.00% | 0.00% | 0.00% | 0.01% | 0.00% | 0.00% | 0.00% | 0.00% | 0.00% | 0.00% |
| ND5.2-DdCBE_replicate2 | A | 0.00% | 99.90% | 0.10% | 0.00% | 0.03% | 0.10% | 99.94% | 99.97% | 0.03% | 0.03% | 0.00% | 0.03% |
| ND5.2-DdCBE_replicate2 | T | 0.10% | 0.00% | 0.03% | 99.97% | 99.90% | 0.13% | 0.00% | 0.00% | 0.03% | 0.00% | 99.97% | 6.92% |
| ND5.2-DdCBE_replicate2 | C | 99.90% | 0.10% | 99.87% | 0.03% | 0.06% | 99.78% | 0.06% | 0.03% | 99.84% | 99.97% | 0.03% | 93.05% |
| ND5.2-DdCBE_replicate2 | G | 0.00% | 0.00% | 0.00% | 0.00% | 0.00% | 0.00% | 0.00% | 0.00% | 0.10% | 0.00% | 0.00% | 0.00% |
| ND5.2-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | — | 0.00% | 0.00% | 0.00% | 0.00% | 0.00% | 0.00% | 0.00% | 0.00% | 0.00% | 0.00% | 0.00% | 0.00% |

TABLE 12C-continued

| | | | | | | | | | | | | | |
|---|---|---|---|---|---|---|---|---|---|---|---|---|---|
| ND5.2-DdCBE_replicate3 | A | 0.04% | 99.95% | 0.07% | 0.01% | 0.01% | 0.16% | 99.95% | 99.95% | 0.04% | 0.05% | 0.02% | 0.05% |
| ND5.2-DdCBE_replicate3 | T | 0.18% | 0.01% | 0.02% | 99.96% | 99.96% | 0.04% | 0.01% | 0.01% | 0.03% | 0.03% | 99.95% | 7.69% |
| ND5.2-DdCBE_replicate3 | C | 99.77% | 0.03% | 99.90% | 0.02% | 0.01% | 99.78% | 0.01% | 0.02% | 99.85% | 99.91% | 0.02% | 92.26% |
| ND5.2-DdCBE_replicate3 | G | 0.00% | 0.01% | 0.00% | 0.00% | 0.01% | 0.01% | 0.02% | 0.01% | 0.08% | 0.01% | 0.00% | 0.00% |
| ND5.2-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | — | 0.00% | 0.00% | 0.00% | 0.00% | 0.00% | 0.01% | 0.00% | 0.00% | 0.00% | 0.00% | 0.00% | 0.00% |

Base Percentages at TALE Binding Sites-ND5.2-DdCBE

| Batch | Nucleotide | C | C | T | C | A | C | C | A | T | T | G | G |
|---|---|---|---|---|---|---|---|---|---|---|---|---|---|
| ND5.2-DdCBE_replicate1 | A | 0.07% | 0.04% | 0.02% | 0.07% | 99.97% | 0.03% | 0.02% | 99.97% | 0.00% | 0.01% | 0.03% | 0.01% |
| ND5.2-DdCBE_replicate1 | T | 5.07% | 0.02% | 99.95% | 0.07% | 0.00% | 0.01% | 0.01% | 0.01% | 99.98% | 99.96% | 0.02% | 0.01% |
| ND5.2-DdCBE_replicate 1 | C | 94.85% | 99.93% | 0.01% | 99.85% | 0.01% | 99.95% | 99.96% | 0.01% | 0.01% | 0.01% | 0.00% | 0.01% |
| ND5.2-DdCBE_replicate1 | G | 0.00% | 0.00% | 0.01% | 0.00% | 0.01% | 0.00% | 0.00% | 0.01% | 0.01% | 0.01% | 99.95% | 99.96% |
| ND5.2-DdCBE_replicate1 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate1 | — | 0.00% | 0.02% | 0.00% | 0.00% | 0.00% | 0.00% | 0.00% | 0.00% | 0.00% | 0.00% | 0.00% | 0.00% |
| ND5.2-DdCBE_replicate2 | A | 0.13% | 0.00% | 0.06% | 0.10% | 100.00% | 0.00% | 0.00% | 100.00% | 0.00% | 0.00% | 0.03% | 0.00% |
| ND5.2-DdCBE_replicate2 | T | 4.73% | 0.00% | 99.90% | 0.03% | 0.00% | 0.00% | 0.00% | 0.00% | 100.00% | 99.97% | 0.03% | 0.03% |
| ND5.2-DdCBE_replicate2 | C | 95.14% | 100.00% | 0.00% | 99.84% | 0.00% | 100.00% | 100.00% | 0.00% | 0.00% | 0.03% | 0.00% | 0.00% |
| ND5.2-DdCBE_replicate2 | G | 0.00% | 0.00% | 0.00% | 0.00% | 0.00% | 0.00% | 0.00% | 0.00% | 0.00% | 0.00% | 99.94% | 99.97% |
| ND5.2-DdCBE_replicate2 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate2 | | 0.00% | 0.00% | 0.03% | 0.03% | 0.00% | 0.00% | 0.00% | 0.00% | 0.00% | 0.00% | 0.00% | 0.00% |
| ND5.2-DdCBE_replicate3 | A | 0.09% | 0.02% | 0.02% | 0.11% | 99.97% | 0.05% | 0.03% | 99.97% | 0.01% | 0.01% | 0.03% | 0.01% |
| ND5.2-DdCBE_replicate3 | T | 5.57% | 0.02% | 99.97% | 0.05% | 0.01% | 0.01% | 0.02% | 0.01% | 99.97% | 99.96% | 0.02% | 0.02% |
| ND5.2-DdCBE_replicate3 | C | 94.33% | 99.93% | 0.01% | 99.83% | 0.01% | 99.93% | 99.94% | 0.01% | 0.01% | 0.02% | 0.00% | 0.00% |
| ND5.2-DdCBE_replicate3 | G | 0.00% | 0.00% | 0.00% | 0.00% | 0.01% | 0.00% | 0.00% | 0.01% | 0.00% | 0.00% | 99.94% | 99.96% |
| ND5.2-DdCBE_replicate3 | N | 0.00% | 0.00% | 0.00% | 0.00% | 0.00% | 0.00% | 0.00% | 0.00% | 0.00% | 0.00% | 0.00% | 0.00% |
| ND5.2-DdCBE_replicate3 | — | 0.00% | 0.02% | 0.00% | 0.00% | 0.00% | 0.00% | 0.00% | 0.00% | 0.00% | 0.00% | 0.00% | 0.00% |

TABLE 12C-continued

Base Percentages at TALE Binding Sites-ND5.2-DdCBE

| ND5.2- | A | C | A | G | C | C | T | A | G | C | A | T | T |
|---|---|---|---|---|---|---|---|---|---|---|---|---|---|
| DdCBE_ replicate1 | | 0.04% | 99.97% | 0.14% | 0.03% | 0.03% | 0.01% | 99.96% | 0.01% | 0.04% | 99.97% | 0.00% | 0.01% |
| ND5.2- DdCBE_ replicate1 | T | 0.04% | 0.00% | 0.01% | 0.01% | 0.01% | 99.97% | 0.01% | 0.02% | 0.01% | 0.01% | 99.98% | 99.97% |
| ND5.2- DdCBE_ replicate 1 | C | 99.92% | 0.01% | 0.00% | 99.95% | 99.95% | 0.01% | 0.01% | 0.00% | 99.94% | 0.01% | 0.01% | 0.01% |
| ND5.2- DdCBE_ replicate1 | G | 0.00% | 0.01% | 99.84% | 0.00% | 0.00% | 0.00% | 0.01% | 99.97% | 0.00% | 0.01% | 0.00% | 0.01% |
| ND5.2- DdCBE_ replicate1 | N | 0.00% | 0.00% | 0.01% | 0.00% | 0.00% | 0.00% | 0.01% | 0.00% | 0.00% | 0.00% | 0.00% | 0.00% |
| ND5.2- DdCBE_ replicate1 | — | 0.00% | 0.00% | 0.00% | 0.00% | 0.00% | 0.00% | 0.00% | 0.00% | 0.00% | 0.00% | 0.00% | 0.01% |
| ND5.2- DdCBE_ replicate2 | A | 0.03% | 99.97% | 0.13% | 0.00% | 0.06% | 0.00% | 99.97% | 0.03% | 0.03% | 100.00% | 0.03% | 0.00% |
| ND5.2- DdCBE_ replicate2 | T | 0.00% | 0.00% | 0.03% | 0.03% | 0.06% | 99.97% | 0.03% | 0.00% | 0.03% | 0.00% | 99.97% | 100.00% |
| ND5.2- DdCBE_ replicate2 | C | 99.97% | 0.00% | 0.00% | 99.97% | 99.87% | 0.03% | 0.00% | 0.00% | 99.94% | 0.00% | 0.00% | 0.00% |
| ND5.2- DdCBE_ replicate2 | G | 0.00% | 0.03% | 99.84% | 0.00% | 0.00% | 0.00% | 0.00% | 99.97% | 0.00% | 0.00% | 0.00% | 0.00% |
| ND5.2- DdCBE_ replicate2 | N | 0.00% | 0.00% | 0.00% | 0.00% | 0.00% | 0.00% | 0.00% | 0.00% | 0.00% | 0.00% | 0.00% | 0.00% |
| ND5.2- DdCBE_ replicate2 | | 0.00% | 0.00% | 0.00% | 0.00% | 0.00% | 0.00% | 0.00% | 0.00% | 0.00% | 0.00% | 0.00% | 0.00% |
| ND5.2- DdCBE_ replicate3 | A | 0.04% | 99.97% | 0.17% | 0.02% | 0.03% | 0.01% | 99.96% | 0.01% | 0.04% | 99.98% | 0.01% | 0.01% |
| ND5.2- DdCBE_ replicate3 | T | 0.02% | 0.00% | 0.01% | 0.02% | 0.01% | 99.96% | 0.01% | 0.01% | 0.02% | 0.01% | 99.97% | 99.97% |
| ND5.2- DdCBE_ replicate3 | C | 99.93% | 0.01% | 0.00% | 99.96% | 99.95% | 0.03% | 0.01% | 0.00% | 99.94% | 0.01% | 0.01% | 0.01% |
| ND5.2- DdCBE_ replicate3 | G | 0.00% | 0.01% | 99.80% | 0.00% | 0.00% | 0.01% | 0.01% | 99.97% | 0.00% | 0.01% | 0.01% | 0.00% |
| ND5.2- DdCBE_ replicate3 | N | 0.00% | 0.00% | 0.01% | 0.00% | 0.00% | 0.00% | 0.01% | 0.00% | 0.00% | 0.00% | 0.00% | 0.00% |
| ND5.2- DdCBE_ replicate3 | — | 0.00% | 0.00% | 0.00% | 0.00% | 0.00% | 0.00% | 0.00% | 0.00% | 0.00% | 0.00% | 0.00% | 0.00% |

Base Percentages at TALE Binding Sites-ND5.2-DdCBE

| Batch | Nucleotide | A | G | C | A | G | G | A | A | T |
|---|---|---|---|---|---|---|---|---|---|---|
| ND5.2- DdCBE_ replicate1 | A | 99.86% | 0.02% | 0.03% | 99.97% | 0.01% | 0.02% | 99.95% | 99.95% | 0.01% |
| ND5.2- DdCBE_ replicate1 | T | 0.01% | 0.02% | 0.03% | 0.01% | 0.01% | 0.02% | 0.02% | 0.02% | 99.97% |
| ND5.2- DdCBE_ replicate 1 | C | 0.00% | 0.01% | 99.94% | 0.00% | 0.00% | 0.00% | 0.01% | 0.01% | 0.02% |
| ND5.2- DdCBE_ replicate1 | G | 0.13% | 99.96% | 0.00% | 0.02% | 99.97% | 99.95% | 0.02% | 0.01% | 0.00% |
| ND5.2- DdCBE_ replicate1 | N | 0.00% | 0.00% | 0.00% | 0.00% | 0.00% | 0.00% | 0.00% | 0.00% | 0.00% |
| ND5.2- DdCBE_ replicate1 | — | 0.01% | 0.00% | 0.00% | 0.00% | 0.00% | 0.00% | 0.00% | 0.00% | 0.00% |

TABLE 12C-continued

| | | | | | | | | | | |
|---|---|---|---|---|---|---|---|---|---|---|
| ND5.2-DdCBE_replicate2 | A | 99.87% | 0.03% | 0.00% | 100.00% | 0.00% | 0.03% | 100.00% | 99.94% | 0.00% |
| ND5.2-DdCBE_replicate2 | T | 0.00% | 0.00% | 0.00% | 0.00% | 0.03% | 0.03% | 0.00% | 0.00% | 100.00% |
| ND5.2-DdCBE_replicate2 | C | 0.00% | 0.00% | 99.97% | 0.00% | 0.00% | 0.00% | 0.00% | 0.03% | 0.00% |
| ND5.2-DdCBE_replicate2 | G | 0.13% | 99.97% | 0.03% | 0.00% | 99.97% | 99.94% | 0.00% | 0.03% | 0.00% |
| ND5.2-DdCBE_replicate2 | N | 0.00% | 0.00% | 0.00% | 0.00% | 0.00% | 0.00% | 0.00% | 0.00% | 0.00% |
| ND5.2-DdCBE_replicate2 | — | 0.00% | 0.00% | 0.00% | 0.00% | 0.00% | 0.00% | 0.00% | 0.00% | 0.00% |
| ND5.2-DdCBE_replicate3 | A | 99.80% | 0.01% | 0.02% | 99.96% | 0.01% | 0.01% | 99.93% | 99.95% | 0.01% |
| ND5.2-DdCBE_replicate3 | T | 0.01% | 0.02% | 0.02% | 0.01% | 0.03% | 0.04% | 0.03% | 0.02% | 99.98% |
| ND5.2-DdCBE_replicate3 | C | 0.02% | 0.01% | 99.96% | 0.01% | 0.00% | 0.01% | 0.02% | 0.02% | 0.01% |
| ND5.2-DdCBE_replicate3 | G | 0.17% | 99.95% | 0.00% | 0.02% | 99.97% | 99.94% | 0.02% | 0.01% | 0.00% |
| ND5.2-DdCBE_replicate3 | N | 0.00% | 0.00% | 0.00% | 0.00% | 0.00% | 0.00% | 0.00% | 0.00% | 0.00% |
| ND5.2-DdCBE_replicate3 | — | 0.00% | 0.00% | 0.00% | 0.00% | 0.00% | 0.01% | 0.00% | 0.00% | 0.00% |

Base Percentages at TALE Binding Sites-ND5.2-DdCBE

| Batch | Nucleotide | A | C | C | T | T | T | C | C | T |
|---|---|---|---|---|---|---|---|---|---|---|
| ND5.2-DdCBE_replicate1 | A | 99.97% | 0.02% | 0.02% | 0.03% | 0.00% | 0.01% | 0.02% | 0.02% | 0.01% |
| ND5.2-DdCBE_replicate1 | T | 0.01% | 0.02% | 0.01% | 99.81% | 99.98% | 99.97% | 0.02% | 0.01% | 99.97% |
| ND5.2-DdCBE_replicate 1 | C | 0.01% | 99.96% | 99.96% | 0.15% | 0.02% | 0.01% | 99.96% | 99.97% | 0.01% |
| ND5.2-DdCBE_replicate1 | G | 0.01% | 0.00% | 0.00% | 0.01% | 0.00% | 0.00% | 0.00% | 0.00% | 0.00% |
| ND5.2-DdCBE_replicate1 | N | 0.00% | 0.00% | 0.00% | 0.00% | 0.00% | 0.00% | 0.00% | 0.00% | 0.00% |
| ND5.2-DdCBE_replicate1 | — | 0.00% | 0.00% | 0.00% | 0.00% | 0.00% | 0.00% | 0.00% | 0.00% | 0.00% |
| ND5.2-DdCBE_replicate2 | A | 99.97% | 0.00% | 0.06% | 0.03% | 0.00% | 0.00% | 0.00% | 0.03% | 0.03% |
| ND5.2-DdCBE_replicate2 | T | 0.03% | 0.00% | 0.00% | 99.84% | 99.97% | 100.00% | 0.00% | 0.00% | 99.97% |
| ND5.2-DdCBE_replicate2 | C | 0.00% | 100.00% | 99.94% | 0.13% | 0.03% | 0.00% | 99.97% | 99.97% | 0.00% |
| ND5.2-DdCBE_replicate2 | G | 0.00% | 0.00% | 0.00% | 0.00% | 0.00% | 0.00% | 0.03% | 0.00% | 0.00% |
| ND5.2-DdCBE_replicate2 | N | 0.00% | 0.00% | 0.00% | 0.00% | 0.00% | 0.00% | 0.00% | 0.00% | 0.00% |
| ND5.2-DdCBE_replicate2 | — | 0.00% | 0.00% | 0.00% | 0.00% | 0.00% | 0.00% | 0.00% | 0.00% | 0.00% |
| ND5.2-DdCBE_replicate3 | A | 99.97% | 0.02% | 0.02% | 0.02% | 0.00% | 0.01% | 0.02% | 0.02% | 0.01% |

TABLE 12C-continued

| | | | | | | | | | | |
|---|---|---|---|---|---|---|---|---|---|---|
| ND5.2-DdCBE_replicate3 | T | 0.01% | 0.01% | 0.01% | 99.81% | 99.98% | 99.97% | 0.02% | 0.01% | 99.98% |
| ND5.2-DdCBE_replicate3 | C | 0.01% | 99.97% | 99.96% | 0.16% | 0.01% | 0.01% | 99.96% | 99.97% | 0.01% |
| ND5.2-DdCBE_replicate3 | G | 0.00% | 0.00% | 0.00% | 0.01% | 0.00% | 0.00% | 0.00% | 0.00% | 0.00% |
| ND5.2-DdCBE_replicate3 | N | 0.00% | 0.00% | 0.00% | 0.00% | 0.00% | 0.00% | 0.00% | 0.00% | 0.00% |
| ND5.2-DdCBE_replicate3 | — | 0.00% | 0.00% | 0.00% | 0.00% | 0.00% | 0.00% | 0.00% | 0.00% | 0.00% |

TABLE 12D

Base Percentages at TALE Binding Sites-ND5.3-DdCBE

| Batch | Nucleotide | A | A | C | T | C | A | G | A |
|---|---|---|---|---|---|---|---|---|---|
| ND5.3-DdCBE_replicate1 | A | 99.96% | 99.98% | 0.01% | 0.00% | 0.01% | 99.99% | 0.03% | 99.99% |
| ND5.3-DdCBE_replicate 1 | T | 0.01% | 0.00% | 0.01% | 99.98% | 0.05% | 0.00% | 0.00% | 0.01% |
| ND5.3-DdCBE_replicate1 | C | 0.01% | 0.00% | 99.99% | 0.01% | 99.95% | 0.00% | 0.00% | 0.00% |
| ND5.3-DdCBE_replicate 1 | G | 0.01% | 0.01% | 0.00% | 0.00% | 0.00% | 0.01% | 99.97% | 0.01% |
| ND5.3-DdCBE_replicate 1 | N | 0.00% | 0.00% | 0.00% | 0.00% | 0.00% | 0.00% | 0.00% | 0.00% |
| ND5.3-DdCBE_replicate 1 | — | 0.00% | 0.01% | 0.00% | 0.00% | 0.00% | 0.00% | 0.00% | 0.00% |
| ND5.3-DdCBE_replicate2 | A | 99.98% | 99.97% | 0.01% | 0.00% | 0.00% | 99.98% | 0.02% | 99.98% |
| ND5.3-DdCBE_replicate2 | T | 0.01% | 0.00% | 0.01% | 99.98% | 0.03% | 0.00% | 0.00% | 0.01% |
| ND5.3-DdCBE_replicate2 | C | 0.01% | 0.00% | 99.98% | 0.01% | 99.96% | 0.00% | 0.00% | 0.00% |
| ND5.3-DdCBE_replicate2 | G | 0.01% | 0.01% | 0.00% | 0.00% | 0.00% | 0.01% | 99.97% | 0.01% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.01% | 0.00% | 0.00% | 0.00% | 0.00% | 0.00% | 0.00% |
| ND5.3-DdCBE_replicate3 | A | 99.98% | 99.97% | 0.01% | 0.00% | 0.01% | 99.97% | 0.01% | 99.98% |
| ND5.3-DdCBE_replicate3 | T | 0.00% | 0.00% | 0.01% | 99.98% | 0.04% | 0.00% | 0.01% | 0.01% |
| ND5.3-DdCBE_replicate3 | C | 0.00% | 0.01% | 99.98% | 0.02% | 99.94% | 0.00% | 0.00% | 0.00% |
| ND5.3-DdCBE_replicate3 | G | 0.01% | 0.01% | 0.00% | 0.00% | 0.00% | 0.03% | 99.98% | 0.01% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.00% | 0.01% | 0.00% | 0.00% | 0.00% | 0.00% | 0.00% | 0.00% |

TABLE 12D-continued

| Base Percentages at TALE Binding Sites-ND5.3-DdCBE | | | | | | | | | |
|---|---|---|---|---|---|---|---|---|---|
| Batch | Nucleotide | T | T | C | T | T | C | A | A |
| ND5.3-DdCBE_replicate 1 | A | 0.02% | 0.01% | 0.00% | 0.01% | 0.01% | 0.01% | 99.97% | 99.97% |
| ND5.3-DdCBE_replicate 1 | T | 99.94% | 99.97% | 0.00% | 99.97% | 99.97% | 0.01% | 0.01% | 0.01% |
| ND5.3-DdCBE_replicate 1 | C | 0.02% | 0.01% | 99.99% | 0.02% | 0.02% | 99.98% | 0.00% | 0.00% |
| ND5.3-DdCBE_replicate 1 | G | 0.02% | 0.00% | 0.00% | 0.01% | 0.00% | 0.00% | 0.01% | 0.02% |
| ND5.3-DdCBE_replicate1 | N | 0.00% | 0.00% | 0.00% | 0.00% | 0.00% | 0.00% | 0.00% | 0.00% |
| ND5.3-DdCBE_replicate1 | — | 0.00% | 0.00% | 0.00% | 0.00% | 0.00% | 0.00% | 0.00% | 0.00% |
| ND5.3-DdCBE_replicate2 | A | 0.01% | 0.01% | 0.01% | 0.00% | 0.01% | 0.01% | 99.96% | 99.96% |
| ND5.3-DdCBE_replicate2 | T | 99.95% | 99.99% | 0.02% | 99.98% | 99.97% | 0.02% | 0.01% | 0.01% |
| ND5.3-DdCBE_replicate2 | C | 0.02% | 0.00% | 99.98% | 0.01% | 0.01% | 99.96% | 0.00% | 0.01% |
| ND5.3-DdCBE_replicate2 | G | 0.02% | 0.00% | 0.00% | 0.00% | 0.01% | 0.00% | 0.02% | 0.02% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.00% | 0.00% | 0.00% | 0.00% | 0.00% | 0.00% | 0.00% |
| ND5.3-DdCBE_replicate3 | A | 0.01% | 0.01% | 0.00% | 0.00% | 0.01% | 0.01% | 99.96% | 99.96% |
| ND5.3-DdCBE_replicate3 | T | 99.94% | 99.97% | 0.01% | 99.99% | 99.98% | 0.01% | 0.01% | 0.01% |
| ND5.3-DdCBE_replicate3 | C | 0.02% | 0.01% | 99.99% | 0.01% | 0.01% | 99.98% | 0.00% | 0.01% |
| ND5.3-DdCBE_replicate3 | G | 0.03% | 0.00% | 0.00% | 0.00% | 0.00% | 0.00% | 0.03% | 0.03% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.00% | 0.00% | 0.00% | 0.00% | 0.00% | 0.00% | 0.00% | 0.00% |
| Batch | Nucleotide | C | T | A | A | T | T | A | C |
| ND5.3-DdCBE_replicate 1 | A | 0.00% | 0.00% | 99.98% | 99.98% | 0.00% | 0.00% | 99.99% | 0.00% |
| ND5.3-DdCBE_replicate 1 | T | 5.40% | 99.99% | 0.00% | 0.00% | 99.99% | 99.98% | 0.01% | 0.01% |
| ND5.3-DdCBE_replicate1 | C | 94.60% | 0.01% | 0.00% | 0.01% | 0.00% | 0.01% | 0.00% | 99.99% |
| ND5.3-DdCBE_replicate 1 | G | 0.00% | 0.00% | 0.01% | 0.00% | 0.00% | 0.00% | 0.01% | 0.00% |
| ND5.3-DdCBE_replicate1 | N | 0.00% | 0.00% | 0.00% | 0.00% | 0.00% | 0.00% | 0.00% | 0.00% |
| ND5.3-DdCBE_replicate 1 | — | 0.00% | 0.00% | 0.00% | 0.01% | 0.00% | 0.01% | 0.00% | 0.00% |

TABLE 12D-continued

| Base Percentages at TALE Binding Sites-ND5.3-DdCBE | | | | | | | | | |
|---|---|---|---|---|---|---|---|---|---|
| ND5.3-DdCBE_replicate2 | A | 0.00% | 0.00% | 99.98% | 99.96% | 0.00% | 0.01% | 99.98% | 0.01% |
| ND5.3-DdCBE_replicate2 | T | 5.00% | 99.97% | 0.00% | 0.01% | 99.99% | 99.97% | 0.01% | 0.01% |
| ND5.3-DdCBE_replicate2 | C | 94.99% | 0.01% | 0.00% | 0.01% | 0.00% | 0.02% | 0.00% | 99.98% |
| ND5.3-DdCBE_replicate2 | G | 0.00% | 0.00% | 0.01% | 0.01% | 0.00% | 0.00% | 0.01% | 0.00% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.01% | 0.00% | 0.01% | 0.00% | 0.00% | 0.00% | 0.00% |
| ND5.3-DdCBE_replicate3 | A | 0.01% | 0.01% | 99.98% | 99.96% | 0.00% | 0.01% | 99.99% | 0.00% |
| ND5.3-DdCBE_replicate3 | T | 5.27% | 99.98% | 0.00% | 0.00% | 99.99% | 99.98% | 0.00% | 0.01% |
| ND5.3-DdCBE_replicate3 | C | 94.72% | 0.01% | 0.01% | 0.02% | 0.01% | 0.01% | 0.00% | 99.99% |
| ND5.3-DdCBE_replicate3 | G | 0.00% | 0.00% | 0.01% | 0.01% | 0.00% | 0.00% | 0.01% | 0.00% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.00% | 0.00% | 0.00% | 0.00% | 0.00% | 0.01% | 0.00% | 0.00% |
| Batch | Nucleotide | A | C | C | G | C | T | A | A |
| ND5.3-DdCBE_replicate 1 | A | 99.99% | 0.00% | 0.02% | 0.02% | 0.00% | 0.00% | 99.98% | 99.96% |
| ND5.3-DdCBE_replicate1 | T | 0.01% | 0.01% | 0.02% | 0.01% | 0.01% | 99.99% | 0.00% | 0.01% |
| ND5.3-DdCBE_replicate 1 | C | 0.00% | 99.99% | 99.96% | 0.01% | 99.98% | 0.01% | 0.01% | 0.01% |
| ND5.3-DdCBE_replicate 1 | G | 0.00% | 0.00% | 0.01% | 99.97% | 0.01% | 0.00% | 0.01% | 0.01% |
| ND5.3-DdCBE_replicate 1 | N | 0.00% | 0.00% | 0.00% | 0.00% | 0.00% | 0.00% | 0.00% | 0.00% |
| ND5.3-DdCBE_replicate 1 | — | 0.00% | 0.00% | 0.00% | 0.00% | 0.00% | 0.00% | 0.00% | 0.01% |
| ND5.3-DdCBE_replicate2 | A | 99.97% | 0.01% | 0.01% | 0.02% | 0.01% | 0.01% | 99.98% | 99.93% |
| ND5.3-DdCBE_replicate2 | T | 0.01% | 0.00% | 0.02% | 0.01% | 0.01% | 99.97% | 0.00% | 0.02% |
| ND5.3-DdCBE_replicate2 | C | 0.01% | 99.99% | 99.96% | 0.01% | 99.98% | 0.02% | 0.00% | 0.02% |
| ND5.3-DdCBE_replicate2 | G | 0.00% | 0.00% | 0.01% | 99.96% | 0.00% | 0.00% | 0.01% | 0.01% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.01% | 0.00% | 0.00% | 0.00% | 0.00% | 0.01% | 0.00% | 0.01% |
| ND5.3-DdCBE_replicate3 | A | 99.96% | 0.01% | 0.01% | 0.02% | 0.01% | 0.01% | 99.98% | 99.96% |

TABLE 12D-continued

| Base Percentages at TALE Binding Sites-ND5.3-DdCBE | | | | | | | | | |
|---|---|---|---|---|---|---|---|---|---|
| ND5.3-DdCBE_ replicate3 | T | 0.01% | 0.01% | 0.01% | 0.01% | 0.00% | 99.99% | 0.00% | 0.01% |
| ND5.3-DdCBE_ replicate3 | C | 0.00% | 99.98% | 99.98% | 0.01% | 99.99% | 0.01% | 0.00% | 0.01% |
| ND5.3-DdCBE_ replicate3 | G | 0.02% | 0.00% | 0.01% | 99.97% | 0.00% | 0.00% | 0.01% | 0.01% |
| ND5.3-DdCBE_ replicate3 | N | 0.00% | 0.00% | 0.00% | 0.00% | 0.00% | 0.00% | 0.00% | 0.00% |
| ND5.3-DdCBE_ replicate3 | — | 0.00% | 0.00% | 0.00% | 0.00% | 0.00% | 0.00% | 0.00% | 0.01% |
| Batch | Nucleotide | C | C | C | A | A | A | C | A |
| ND5.3-DdCBE_ replicate1 | A | 0.01% | 0.01% | 0.01% | 99.97% | 99.98% | 99.98% | 0.02% | 99.96% |
| ND5.3-DdCBE_ replicate 1 | T | 0.01% | 0.01% | 0.01% | 0.00% | 0.00% | 0.01% | 0.01% | 0.01% |
| ND5.3-DdCBE_ replicate1 | C | 99.98% | 99.97% | 99.97% | 0.00% | 0.00% | 0.00% | 99.97% | 0.02% |
| ND5.3-DdCBE_ replicate 1 | G | 0.00% | 0.00% | 0.00% | 0.02% | 0.02% | 0.01% | 0.00% | 0.01% |
| ND5.3-DdCBE_ replicate 1 | N | 0.00% | 0.00% | 0.00% | 0.00% | 0.00% | 0.00% | 0.00% | 0.00% |
| ND5.3-DdCBE_ replicate 1 | — | 0.00% | 0.00% | 0.00% | 0.00% | 0.00% | 0.00% | 0.00% | 0.00% |
| ND5.3-DdCBE_ replicate2 | A | 0.00% | 0.01% | 0.00% | 99.98% | 99.98% | 99.98% | 0.02% | 99.96% |
| ND5.3-DdCBE_ replicate2 | T | 0.01% | 0.01% | 0.01% | 0.00% | 0.01% | 0.00% | 0.01% | 0.00% |
| ND5.3-DdCBE_ replicate2 | C | 99.99% | 99.98% | 99.98% | 0.00% | 0.01% | 0.01% | 99.97% | 0.02% |
| ND5.3-DdCBE_ replicate2 | G | 0.00% | 0.00% | 0.00% | 0.02% | 0.01% | 0.01% | 0.00% | 0.02% |
| ND5.3-DdCBE_ replicate2 | N | 0.00% | 0.00% | 0.00% | 0.00% | 0.00% | 0.00% | 0.00% | 0.00% |
| ND5.3-DdCBE_ replicate2 | — | 0.00% | 0.00% | 0.00% | 0.00% | 0.00% | 0.00% | 0.00% | 0.00% |
| ND5.3-DdCBE_ replicate3 | A | 0.01% | 0.01% | 0.01% | 99.97% | 99.97% | 99.96% | 0.03% | 99.96% |
| ND5.3-DdCBE_ replicate3 | T | 0.01% | 0.01% | 0.01% | 0.00% | 0.01% | 0.01% | 0.01% | 0.00% |
| ND5.3-DdCBE_ replicate3 | C | 99.98% | 99.98% | 99.97% | 0.01% | 0.00% | 0.01% | 99.96% | 0.02% |
| ND5.3-DdCBE_ replicate3 | G | 0.00% | 0.00% | 0.00% | 0.01% | 0.02% | 0.01% | 0.01% | 0.01% |
| ND5.3-DdCBE_ replicate3 | N | 0.00% | 0.00% | 0.00% | 0.00% | 0.00% | 0.00% | 0.00% | 0.00% |
| ND5.3-DdCBE_ replicate3 | — | 0.00% | 0.00% | 0.00% | 0.00% | 0.00% | 0.01% | 0.00% | 0.00% |
| Batch | Nucleotide | A | T | A | T | C | T | A | C |
| ND5.3-DdCBE_ replicate 1 | A | 99.99% | 0.01% | 99.99% | 0.01% | 0.01% | 0.00% | 99.97% | 0.00% |

TABLE 12D-continued

| Base Percentages at TALE Binding Sites-ND5.3-DdCBE | | | | | | | | | |
|---|---|---|---|---|---|---|---|---|---|
| ND5.3-DdCBE_ replicate 1 | T | 0.00% | 99.98% | 0.01% | 99.99% | 0.01% | 99.99% | 0.02% | 22.67% |
| ND5.3-DdCBE_ replicate 1 | C | 0.00% | 0.01% | 0.00% | 0.00% | 99.98% | 0.01% | 0.01% | 77.32% |
| ND5.3-DdCBE_ replicate 1 | G | 0.01% | 0.00% | 0.01% | 0.00% | 0.00% | 0.00% | 0.01% | 0.00% |
| ND5.3-DdCBE_ replicate1 | N | 0.00% | 0.00% | 0.00% | 0.00% | 0.00% | 0.00% | 0.00% | 0.00% |
| ND5.3-DdCBE_ replicate1 | — | 0.00% | 0.00% | 0.00% | 0.00% | 0.00% | 0.00% | 0.00% | 0.00% |
| ND5.3-DdCBE_ replicate2 | A | 99.99% | 0.01% | 99.98% | 0.00% | 0.00% | 0.01% | 99.98% | 0.00% |
| ND5.3-DdCBE_ replicate2 | T | 0.00% | 99.98% | 0.01% | 99.99% | 0.02% | 99.97% | 0.01% | 21.07% |
| ND5.3-DdCBE_ replicate2 | C | 0.00% | 0.02% | 0.00% | 0.01% | 99.98% | 0.02% | 0.00% | 78.92% |
| ND5.3-DdCBE_ replicate2 | G | 0.01% | 0.00% | 0.01% | 0.00% | 0.00% | 0.00% | 0.01% | 0.00% |
| ND5.3-DdCBE_ replicate2 | N | 0.00% | 0.00% | 0.00% | 0.00% | 0.00% | 0.00% | 0.00% | 0.00% |
| ND5.3-DdCBE_ replicate2 | — | 0.00% | 0.00% | 0.00% | 0.00% | 0.00% | 0.00% | 0.00% | 0.00% |
| ND5.3-DdCBE_ replicate3 | A | 99.98% | 0.00% | 99.98% | 0.01% | 0.01% | 0.01% | 99.99% | 0.01% |
| ND5.3-DdCBE_ replicate3 | T | 0.01% | 99.99% | 0.01% | 99.99% | 0.01% | 99.99% | 0.01% | 16.15% |
| ND5.3-DdCBE_ replicate3 | C | 0.00% | 0.01% | 0.00% | 0.01% | 99.98% | 0.01% | 0.00% | 83.84% |
| ND5.3-DdCBE_ replicate3 | G | 0.00% | 0.00% | 0.01% | 0.00% | 0.00% | 0.00% | 0.00% | 0.00% |
| ND5.3-DdCBE_ replicate3 | N | 0.00% | 0.00% | 0.00% | 0.00% | 0.00% | 0.00% | 0.00% | 0.00% |
| ND5.3-DdCBE_ replicate3 | — | 0.00% | 0.00% | 0.00% | 0.00% | 0.00% | 0.00% | 0.00% | 0.00% |

| Batch | Nucleotide | C | A | T | A | C | T | A | A |
|---|---|---|---|---|---|---|---|---|---|
| ND5.3-DdCBE_ replicate 1 | A | 0.01% | 99.98% | 0.00% | 99.97% | 0.00% | 0.01% | 99.99% | 99.96% |
| ND5.3-DdCBE_ replicate 1 | T | 0.01% | 0.01% | 99.98% | 0.01% | 0.01% | 99.97% | 0.00% | 0.01% |
| ND5.3-DdCBE_ replicate1 | C | 99.98% | 0.00% | 0.01% | 0.01% | 99.99% | 0.01% | 0.00% | 0.02% |
| ND5.3-DdCBE_ replicate 1 | G | 0.00% | 0.01% | 0.00% | 0.01% | 0.00% | 0.00% | 0.01% | 0.01% |
| ND5.3-DdCBE_ replicate1 | N | 0.00% | 0.00% | 0.00% | 0.00% | 0.00% | 0.00% | 0.00% | 0.00% |
| ND5.3-DdCBE_ replicate 1 | — | 0.00% | 0.00% | 0.00% | 0.00% | 0.00% | 0.00% | 0.00% | 0.00% |
| ND5.3-DdCBE_ replicate2 | A | 0.01% | 99.97% | 0.00% | 99.97% | 0.01% | 0.00% | 99.99% | 99.96% |
| ND5.3-DdCBE_ replicate2 | T | 0.01% | 0.02% | 99.98% | 0.01% | 0.00% | 99.98% | 0.00% | 0.02% |

TABLE 12D-continued

| Base Percentages at TALE Binding Sites-ND5.3-DdCBE | | | | | | | | | |
|---|---|---|---|---|---|---|---|---|---|
| ND5.3-DdCBE_replicate2 | C | 99.98% | 0.00% | 0.01% | 0.01% | 99.99% | 0.01% | 0.00% | 0.01% |
| ND5.3-DdCBE_replicate2 | G | 0.00% | 0.00% | 0.00% | 0.01% | 0.00% | 0.00% | 0.01% | 0.01% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.00% | 0.00% | 0.00% | 0.00% | 0.00% | 0.00% | 0.00% |
| ND5.3-DdCBE_replicate3 | A | 0.01% | 99.98% | 0.01% | 99.98% | 0.01% | 0.01% | 99.99% | 99.98% |
| ND5.3-DdCBE_replicate3 | T | 0.01% | 0.01% | 99.98% | 0.01% | 0.01% | 99.97% | 0.00% | 0.01% |
| ND5.3-DdCBE_replicate3 | C | 99.97% | 0.00% | 0.01% | 0.00% | 99.99% | 0.01% | 0.00% | 0.01% |
| ND5.3-DdCBE_replicate3 | G | 0.00% | 0.01% | 0.00% | 0.01% | 0.00% | 0.00% | 0.01% | 0.00% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.01% | 0.00% | 0.00% | 0.00% | 0.00% | 0.01% | 0.00% | 0.01% |
| Batch | Nucleotide | C | A | A | C | C | T | A | T |
| ND5.3-DdCBE_replicate 1 | A | 0.01% | 99.98% | 99.96% | 0.01% | 0.00% | 0.00% | 99.97% | 0.00% |
| ND5.3-DdCBE_replicate1 | T | 0.01% | 0.00% | 0.01% | 0.01% | 0.01% | 99.98% | 0.02% | 99.99% |
| ND5.3-DdCBE_replicate 1 | C | 99.97% | 0.00% | 0.01% | 99.98% | 99.98% | 0.01% | 0.01% | 0.01% |
| ND5.3-DdCBE_replicate 1 | G | 0.01% | 0.01% | 0.01% | 0.00% | 0.00% | 0.00% | 0.01% | 0.00% |
| ND5.3-DdCBE_replicate 1 | N | 0.00% | 0.00% | 0.00% | 0.00% | 0.00% | 0.00% | 0.00% | 0.00% |
| ND5.3-DdCBE_replicate 1 | — | 0.00% | 0.00% | 0.01% | 0.00% | 0.00% | 0.00% | 0.00% | 0.00% |
| ND5.3-DdCBE_replicate2 | A | 0.01% | 99.99% | 99.98% | 0.00% | 0.02% | 0.01% | 99.97% | 0.00% |
| ND5.3-DdCBE_replicate2 | T | 0.01% | 0.00% | 0.01% | 0.01% | 0.01% | 99.98% | 0.01% | 99.98% |
| ND5.3-DdCBE_replicate2 | C | 99.98% | 0.00% | 0.01% | 99.99% | 99.97% | 0.01% | 0.00% | 0.02% |
| ND5.3-DdCBE_replicate2 | G | 0.00% | 0.01% | 0.01% | 0.00% | 0.00% | 0.00% | 0.01% | 0.00% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.00% | 0.00% | 0.00% | 0.00% | 0.00% | 0.00% | 0.00% |
| ND5.3-DdCBE_replicate3 | A | 0.01% | 99.98% | 99.97% | 0.01% | 0.01% | 0.01% | 99.96% | 0.00% |
| ND5.3-DdCBE_replicate3 | T | 0.01% | 0.00% | 0.01% | 0.01% | 0.01% | 99.98% | 0.02% | 99.98% |
| ND5.3-DdCBE_replicate3 | C | 99.99% | 0.01% | 0.01% | 99.99% | 99.99% | 0.01% | 0.01% | 0.02% |

TABLE 12D-continued

| Base Percentages at TALE Binding Sites-ND5.3-DdCBE | | | | | | | | | |
|---|---|---|---|---|---|---|---|---|---|
| ND5.3-DdCBE_ replicate3 | G | 0.00% | 0.01% | 0.01% | 0.00% | 0.00% | 0.00% | 0.01% | 0.00% |
| ND5.3-DdCBE_ replicate3 | N | 0.00% | 0.00% | 0.00% | 0.00% | 0.00% | 0.00% | 0.00% | 0.00% |
| ND5.3-DdCBE_ replicate3 | — | 0.00% | 0.00% | 0.00% | 0.00% | 0.00% | 0.00% | 0.00% | 0.00% |
| Batch | Nucleotide | T | T | A | A | T | C | A | G |
| ND5.3-DdCBE_ replicate1 | A | 0.00% | 0.00% | 99.97% | 99.95% | 0.01% | 0.02% | 99.97% | 0.09% |
| ND5.3-DdCBE_ replicate 1 | T | 100.00% | 99.98% | 0.02% | 0.02% | 99.98% | 0.01% | 0.01% | 0.01% |
| ND5.3-DdCBE_ replicate1 | C | 0.00% | 0.01% | 0.01% | 0.01% | 0.01% | 99.97% | 0.00% | 0.00% |
| ND5.3-DdCBE_ replicate 1 | G | 0.00% | 0.00% | 0.01% | 0.01% | 0.00% | 0.00% | 0.02% | 99.90% |
| ND5.3-DdCBE_ replicate 1 | N | 0.00% | 0.00% | 0.00% | 0.00% | 0.00% | 0.00% | 0.00% | 0.00% |
| ND5.3-DdCBE_ replicate 1 | — | 0.00% | 0.00% | 0.00% | 0.00% | 0.00% | 0.00% | 0.00% | 0.00% |
| ND5.3-DdCBE_ replicate2 | A | 0.00% | 0.01% | 99.96% | 99.95% | 0.01% | 0.02% | 99.99% | 0.09% |
| ND5.3-DdCBE_ replicate2 | T | 99.98% | 99.98% | 0.02% | 0.03% | 99.98% | 0.01% | 0.00% | 0.00% |
| ND5.3-DdCBE_ replicate2 | C | 0.02% | 0.02% | 0.00% | 0.01% | 0.01% | 99.96% | 0.00% | 0.00% |
| ND5.3-DdCBE_ replicate2 | G | 0.00% | 0.00% | 0.01% | 0.01% | 0.00% | 0.00% | 0.00% | 99.91% |
| ND5.3-DdCBE_ replicate2 | N | 0.00% | 0.00% | 0.00% | 0.00% | 0.00% | 0.00% | 0.00% | 0.00% |
| ND5.3-DdCBE_ replicate2 | — | 0.00% | 0.00% | 0.00% | 0.00% | 0.00% | 0.00% | 0.00% | 0.00% |
| ND5.3-DdCBE_ replicate3 | A | 0.00% | 0.01% | 99.96% | 99.94% | 0.01% | 0.02% | 99.97% | 0.07% |
| ND5.3-DdCBE_ replicate3 | T | 99.99% | 99.98% | 0.03% | 0.03% | 99.98% | 0.01% | 0.01% | 0.00% |
| ND5.3-DdCBE_ replicate3 | C | 0.01% | 0.01% | 0.00% | 0.02% | 0.01% | 99.97% | 0.01% | 0.00% |
| ND5.3-DdCBE_ replicate3 | G | 0.00% | 0.00% | 0.01% | 0.01% | 0.00% | 0.00% | 0.01% | 99.93% |
| ND5.3-DdCBE_ replicate3 | N | 0.00% | 0.00% | 0.00% | 0.00% | 0.00% | 0.00% | 0.00% | 0.00% |
| ND5.3-DdCBE_ replicate3 | — | 0.00% | 0.00% | 0.00% | 0.00% | 0.00% | 0.00% | 0.00% | 0.00% |
| Batch | Nucleotide | T | C | A | T | C | T | T | C |
| ND5.3-DdCBE_ replicate 1 | A | 0.02% | 0.01% | 99.98% | 0.00% | 0.00% | 0.01% | 0.00% | 0.01% |
| ND5.3-DdCBE_ replicate 1 | T | 99.98% | 0.02% | 0.00% | 99.98% | 0.10% | 99.97% | 99.98% | 28.54% |
| ND5.3-DdCBE_ replicate 1 | C | 0.00% | 99.97% | 0.01% | 0.01% | 99.90% | 0.02% | 0.02% | 71.45% |

TABLE 12D-continued

| Base Percentages at TALE Binding Sites-ND5.3-DdCBE | | | | | | | | | |
|---|---|---|---|---|---|---|---|---|---|
| ND5.3-DdCBE_replicate 1 | G | 0.00% | 0.00% | 0.01% | 0.00% | 0.00% | 0.00% | 0.00% | 0.00% |
| ND5.3-DdCBE_replicate1 | N | 0.00% | 0.00% | 0.00% | 0.00% | 0.00% | 0.00% | 0.00% | 0.00% |
| ND5.3-DdCBE_replicate1 | — | 0.00% | 0.00% | 0.00% | 0.00% | 0.00% | 0.00% | 0.00% | 0.00% |
| ND5.3-DdCBE_replicate2 | A | 0.02% | 0.01% | 99.96% | 0.01% | 0.00% | 0.01% | 0.01% | 0.00% |
| ND5.3-DdCBE_replicate2 | T | 99.98% | 0.02% | 0.01% | 99.98% | 0.11% | 99.98% | 99.97% | 26.39% |
| ND5.3-DdCBE_replicate2 | C | 0.01% | 99.97% | 0.01% | 0.01% | 99.89% | 0.01% | 0.02% | 73.61% |
| ND5.3-DdCBE_replicate2 | G | 0.00% | 0.00% | 0.01% | 0.00% | 0.00% | 0.00% | 0.01% | 0.00% |
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.00% | 0.00% | 0.00% | 0.00% | 0.00% | 0.00% | 0.00% |
| ND5.3-DdCBE_replicate3 | A | 0.01% | 0.01% | 99.98% | 0.00% | 0.00% | 0.01% | 0.00% | 0.00% |
| ND5.3-DdCBE_replicate3 | T | 99.98% | 0.03% | 0.00% | 99.99% | 0.11% | 99.97% | 99.98% | 25.96% |
| ND5.3-DdCBE_replicate3 | C | 0.01% | 99.96% | 0.01% | 0.01% | 99.89% | 0.01% | 0.01% | 74.04% |
| ND5.3-DdCBE_replicate3 | G | 0.00% | 0.01% | 0.01% | 0.00% | 0.00% | 0.00% | 0.01% | 0.00% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.00% | 0.00% | 0.00% | 0.00% | 0.00% | 0.00% | 0.00% | 0.00% |
| Batch | Nucleotide | T | C | T | T | A | G | T | T |
| ND5.3-DdCBE_replicate 1 | A | 0.01% | 0.00% | 0.01% | 0.01% | 99.99% | 0.01% | 0.02% | 0.01% |
| ND5.3-DdCBE_replicate 1 | T | 99.98% | 0.01% | 99.98% | 99.97% | 0.00% | 0.01% | 99.97% | 99.97% |
| ND5.3-DdCBE_replicate1 | C | 0.01% | 99.98% | 0.01% | 0.02% | 0.00% | 0.00% | 0.01% | 0.01% |
| ND5.3-DdCBE_replicate 1 | G | 0.00% | 0.00% | 0.00% | 0.00% | 0.01% | 99.97% | 0.00% | 0.00% |
| ND5.3-DdCBE_replicate1 | N | 0.00% | 0.00% | 0.00% | 0.00% | 0.00% | 0.00% | 0.00% | 0.00% |
| ND5.3-DdCBE_replicate 1 | — | 0.00% | 0.00% | 0.00% | 0.01% | 0.00% | 0.00% | 0.00% | 0.01% |
| ND5.3-DdCBE_replicate2 | A | 0.00% | 0.00% | 0.00% | 0.01% | 99.98% | 0.01% | 0.02% | 0.01% |
| ND5.3-DdCBE_replicate2 | T | 99.98% | 0.01% | 99.98% | 99.97% | 0.00% | 0.02% | 99.97% | 99.97% |
| ND5.3-DdCBE_replicate2 | C | 0.02% | 99.99% | 0.01% | 0.02% | 0.01% | 0.00% | 0.01% | 0.01% |
| ND5.3-DdCBE_replicate2 | G | 0.00% | 0.00% | 0.00% | 0.00% | 0.02% | 99.97% | 0.00% | 0.00% |

TABLE 12D-continued

| Base Percentages at TALE Binding Sites-ND5.3-DdCBE | | | | | | | | | |
|---|---|---|---|---|---|---|---|---|---|
| ND5.3-DdCBE_replicate2 | N | 0.00% | 0.00% | 0.00% | 0.00% | 0.00% | 0.00% | 0.00% | 0.00% |
| ND5.3-DdCBE_replicate2 | — | 0.00% | 0.00% | 0.00% | 0.01% | 0.00% | 0.00% | 0.00% | 0.01% |
| ND5.3-DdCBE_replicate3 | A | 0.00% | 0.00% | 0.01% | 0.00% | 99.99% | 0.01% | 0.01% | 0.01% |
| ND5.3-DdCBE_replicate3 | T | 99.99% | 0.00% | 99.97% | 99.97% | 0.00% | 0.01% | 99.98% | 99.98% |
| ND5.3-DdCBE_replicate3 | C | 0.01% | 99.99% | 0.01% | 0.01% | 0.00% | 0.00% | 0.01% | 0.00% |
| ND5.3-DdCBE_replicate3 | G | 0.00% | 0.00% | 0.00% | 0.00% | 0.01% | 99.97% | 0.00% | 0.00% |
| ND5.3-DdCBE_replicate3 | N | 0.00% | 0.00% | 0.00% | 0.00% | 0.00% | 0.00% | 0.00% | 0.00% |
| ND5.3-DdCBE_replicate3 | — | 0.00% | 0.00% | 0.00% | 0.01% | 0.00% | 0.00% | 0.00% | 0.01% |

| Batch | Nucleotide | T |
|---|---|---|
| ND5.3-DdCBE_replicate 1 | A | 0.01% |
| ND5.3-DdCBE_replicate1 | T | 99.98% |
| ND5.3-DdCBE_replicate 1 | C | 0.01% |
| ND5.3-DdCBE_replicate 1 | G | 0.00% |
| ND5.3-DdCBE_replicate 1 | N | 0.00% |
| ND5.3-DdCBE_replicate 1 | — | 0.00% |
| ND5.3-DdCBE_replicate2 | A | 0.01% |
| ND5.3-DdCBE_replicate2 | T | 99.98% |
| ND5.3-DdCBE_replicate2 | C | 0.01% |
| ND5.3-DdCBE_replicate2 | G | 0.00% |
| ND5.3-DdCBE_replicate2 | N | 0.00% |
| ND5.3-DdCBE_replicate2 | — | 0.00% |
| ND5.3-DdCBE_replicate3 | A | 0.01% |
| ND5.3-DdCBE_replicate3 | T | 99.97% |
| ND5.3-DdCBE_replicate3 | C | 0.01% |
| ND5.3-DdCBE_replicate3 | G | 0.00% |
| ND5.3-DdCBE_replicate3 | N | 0.00% |

TABLE 12D-continued

| Base Percentages at TALE Binding Sites-ND5.3-DdCBE | | |
|---|---|---|
| ND5.3-DdCBE_ replicate3 | — | 0.00% |

TABLE 12E

| Base Percentages at TALE Binding Sites-ND4-DdCBE | | | | | | | | | |
|---|---|---|---|---|---|---|---|---|---|
| Batch | Nucleotide | C | C | T | A | C | T | G | G |
| ND4-DdCBE_ replicate 1 | A | 0.00% | 0.02% | 0.01% | 99.98% | 0.00% | 0.01% | 0.25% | 0.01% |
| ND4-DdCBE_ replicate1 | T | 0.01% | 0.01% | 99.98% | 0.00% | 0.01% | 99.98% | 0.01% | 0.01% |
| ND4-DdCBE_ replicate 1 | C | 99.99% | 99.97% | 0.01% | 0.00% | 99.99% | 0.01% | 0.00% | 0.04% |
| ND4-DdCBE_ replicate1 | G | 0.00% | 0.00% | 0.01% | 0.01% | 0.00% | 0.00% | 99.74% | 99.94% |
| ND4-DdCBE_ replicate 1 | N | 0.00% | 0.00% | 0.00% | 0.00% | 0.00% | 0.00% | 0.00% | 0.00% |
| ND4-DdCBE_ replicate1 | — | 0.00% | 0.00% | 0.00% | 0.00% | 0.00% | 0.00% | 0.00% | 0.00% |
| ND4-DdCBE_ replicate2 | A | 0.01% | 0.03% | 0.01% | 99.99% | 0.00% | 0.01% | 0.25% | 0.02% |
| ND4-DdCBE_ replicate2 | T | 0.00% | 0.01% | 99.96% | 0.00% | 0.00% | 99.97% | 0.03% | 0.01% |
| ND4 DdCBE_ replicate2 | C | 99.99% | 99.96% | 0.02% | 0.00% | 100.00% | 0.02% | 0.00% | 0.02% |
| ND4 DdCBE_ replicate2 | G | 0.00% | 0.00% | 0.01% | 0.01% | 0.00% | 0.00% | 99.72% | 99.94% |
| ND4-DdCBE_ replicate2 | N | 0.00% | 0.00% | 0.00% | 0.00% | 0.00% | 0.00% | 0.00% | 0.00% |
| ND4-DdCBE_ replicate2 | — | 0.00% | 0.00% | 0.00% | 0.00% | 0.00% | 0.00% | 0.00% | 0.00% |
| ND4 DdCBE_ replicate3 | A | 0.00% | 0.02% | 0.00% | 99.98% | 0.00% | 0.01% | 0.20% | 0.01% |
| ND4 DdCBE_ replicate3 | T | 0.00% | 0.01% | 99.97% | 0.01% | 0.01% | 99.98% | 0.02% | 0.02% |
| ND4-DdCBE_ replicate3 | C | 99.99% | 99.96% | 0.02% | 0.01% | 99.99% | 0.01% | 0.00% | 0.03% |
| ND4-DdCBE_ replicate3 | G | 0.00% | 0.00% | 0.01% | 0.00% | 0.00% | 0.00% | 99.77% | 99.94% |
| ND4-DdCBE_ replicate3 | N | 0.00% | 0.00% | 0.00% | 0.00% | 0.00% | 0.00% | 0.00% | 0.00% |
| ND4-DdCBE_ replicate3 | | 0.00% | 0.00% | 0.00% | 0.00% | 0.00% | 0.00% | 0.00% | 0.00% |
| Batch | Nucleotide | A | G | T | A | A | C | C | A |
| ND4-DdCBE_ replicate 1 | A | 99.98% | 0.01% | 0.01% | 99.98% | 99.97% | 0.01% | 0.01% | 99.97% |
| ND4-DdCBE_ replicate1 | T | 0.00% | 0.01% | 99.91% | 0.00% | 0.02% | 0.01% | 0.01% | 0.01% |

TABLE 12E-continued

| Base Percentages at TALE Binding Sites-ND4-DdCBE | | | | | | | | | |
|---|---|---|---|---|---|---|---|---|---|
| ND4-DdCBE_replicate1 | C | 0.01% | 0.00% | 0.09% | 0.01% | 0.00% | 99.98% | 99.98% | 0.01% |
| ND4-DdCBE_replicate1 | G | 0.01% | 99.98% | 0.00% | 0.01% | 0.01% | 0.00% | 0.00% | 0.01% |
| ND4-DdCBE_replicate1 | N | 0.00% | 0.00% | 0.00% | 0.00% | 0.00% | 0.00% | 0.00% | 0.00% |
| ND4-DdCBE_replicate1 | — | 0.00% | 0.00% | 0.00% | 0.00% | 0.01% | 0.00% | 0.00% | 0.00% |
| ND4-DdCBE_replicate2 | A | 99.98% | 0.01% | 0.01% | 99.98% | 99.98% | 0.00% | 0.01% | 99.98% |
| ND4-DdCBE_replicate2 | T | 0.01% | 0.01% | 99.92% | 0.01% | 0.01% | 0.01% | 0.01% | 0.01% |
| ND4-DdCBE_replicate2 | C | 0.01% | 0.00% | 0.07% | 0.00% | 0.01% | 99.99% | 99.97% | 0.00% |
| ND4-DdCBE_replicate2 | G | 0.01% | 99.99% | 0.00% | 0.01% | 0.00% | 0.00% | 0.00% | 0.01% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4-DdCBE_replicate3 | A | 99.98% | 0.01% | 0.01% | 99.98% | 99.97% | 0.00% | 0.01% | 99.98% |
| ND4-DdCBE_replicate3 | T | 0.01% | 0.01% | 99.93% | 0.00% | 0.01% | 0.01% | 0.02% | 0.01% |
| ND4-DdCBE_replicate3 | C | 0.01% | 0.00% | 0.06% | 0.01% | 0.01% | 99.99% | 99.96% | 0.01% |
| ND4-DdCBE_replicate3 | G | 0.01% | 99.98% | 0.00% | 0.01% | 0.01% | 0.00% | 0.01% | 0.01% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.01% | 0.00% | 0.01% | 0.00% |
| Batch | Nucleotide | T | A | T | C | A | C | T | C |
| ND4-DdCBE_replicate 1 | A | 0.00% | 99.97% | 0.01% | 0.01% | 99.97% | 0.01% | 0.01% | 0.01% |
| ND4-DdCBE_replicate1 | T | 99.99% | 0.02% | 99.98% | 0.02% | 0.01% | 0.01% | 99.98% | 0.01% |
| ND4-DdCBE_replicate 1 | C | 0.01% | 0.00% | 0.01% | 99.97% | 0.01% | 99.98% | 0.01% | 99.98% |
| ND4-DdCBE_replicate 1 | G | 0.00% | 0.01% | 0.00% | 0.00% | 0.01% | 0.00% | 0.00% | 0.00% |
| ND4-DdCBE_replicate 1 | N | 0.00% | 0.00% | 0.00% | 0.00% | 0.00% | 0.00% | 0.00% | 0.00% |
| ND4-DdCBE_replicate 1 | | 0.00% | 0.00% | 0.00% | 0.00% | 0.00% | 0.00% | 0.00% | 0.00% |
| ND4-DdCBE_replicate2 | A | 0.01% | 99.98% | 0.00% | 0.00% | 99.95% | 0.00% | 0.01% | 0.00% |
| ND4-DdCBE_replicate2 | T | 99.98% | 0.00% | 99.99% | 0.02% | 0.01% | 0.01% | 99.98% | 0.01% |
| ND4-DdCBE_replicate2 | C | 0.01% | 0.01% | 0.01% | 99.98% | 0.03% | 99.99% | 0.01% | 99.99% |

TABLE 12E-continued

| Base Percentages at TALE Binding Sites-ND4-DdCBE | | | | | | | | | |
|---|---|---|---|---|---|---|---|---|---|
| ND4-DdCBE_replicate2 | G | 0.00% | 0.01% | 0.00% | 0.00% | 0.01% | 0.00% | 0.00% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4-DdCBE_replicate3 | A | 0.01% | 99.98% | 0.01% | 0.01% | 99.97% | 0.01% | 0.01% | 0.01% |
| ND4-DdCBE_replicate3 | T | 99.99% | 0.01% | 99.97% | 0.02% | 0.01% | 0.01% | 99.98% | 0.01% |
| ND4-DdCBE_replicate3 | C | 0.01% | 0.00% | 0.01% | 99.97% | 0.01% | 99.98% | 0.01% | 99.98% |
| ND4-DdCBE_replicate3 | G | 0.00% | 0.01% | 0.00% | 0.00% | 0.01% | 0.00% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.00% | 0.00% | 0.00% | 0.00% |
| Batch | Nucleotide | C | A | A | C | A | T | A | C |
| ND4-DdCBE_replicate1 | A | 0.01% | 99.98% | 99.95% | 0.00% | 99.97% | 0.01% | 99.96% | 0.00% |
| ND4-DdCBE_replicate 1 | T | 0.02% | 0.00% | 0.01% | 0.01% | 0.02% | 99.99% | 0.01% | 0.02% |
| ND4-DdCBE_replicate 1 | C | 99.97% | 0.01% | 0.02% | 99.98% | 0.01% | 0.01% | 0.02% | 99.98% |
| ND4-DdCBE_replicate 1 | G | 0.00% | 0.01% | 0.01% | 0.00% | 0.01% | 0.00% | 0.01% | 0.00% |
| ND4-DdCBE_replicate1 | N | 0.00% | 0.00% | 0.00% | 0.00% | 0.00% | 0.00% | 0.00% | 0.00% |
| ND4-DdCBE_replicate1 | — | 0.00% | 0.00% | 0.00% | 0.00% | 0.00% | 0.00% | 0.00% | 0.00% |
| ND4-DdCBE_replicate2 | A | 0.01% | 99.96% | 99.94% | 0.01% | 99.98% | 0.00% | 99.97% | 0.01% |
| ND4-DdCBE_replicate2 | T | 0.01% | 0.00% | 0.02% | 0.01% | 0.01% | 99.99% | 0.01% | 0.01% |
| ND4-DdCBE_replicate2 | C | 99.98% | 0.03% | 0.03% | 99.98% | 0.00% | 0.00% | 0.01% | 99.99% |
| ND4-DdCBE_replicate2 | G | 0.00% | 0.02% | 0.02% | 0.00% | 0.01% | 0.00% | 0.01% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4-DdCBE_replicate3 | A | 0.01% | 99.97% | 99.96% | 0.00% | 99.98% | 0.00% | 99.97% | 0.00% |
| ND4-DdCBE_replicate3 | T | 0.01% | 0.00% | 0.01% | 0.01% | 0.01% | 99.99% | 0.01% | 0.02% |
| ND4-DdCBE_replicate3 | C | 99.98% | 0.01% | 0.02% | 99.99% | 0.00% | 0.01% | 0.01% | 99.98% |
| ND4-DdCBE_replicate3 | G | 0.00% | 0.02% | 0.01% | 0.00% | 0.01% | 0.00% | 0.00% | 0.00% |

TABLE 12E-continued

| Base Percentages at TALE Binding Sites-ND4-DdCBE | | | | | | | | | |
|---|---|---|---|---|---|---|---|---|---|
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.00% | 0.00% | 0.00% | 0.00% |
| Batch | Nucleotide | G | A | G | A | A | C | T | C |
| ND4-DdCBE_replicate 1 | A | 0.02% | 99.95% | 0.01% | 99.96% | 99.97% | 0.01% | 0.00% | 0.00% |
| ND4-DdCBE_replicate1 | T | 0.03% | 0.02% | 0.02% | 0.01% | 0.01% | 0.01% | 99.98% | 0.01% |
| ND4-DdCBE_replicate 1 | C | 0.00% | 0.02% | 0.00% | 0.02% | 0.00% | 99.98% | 0.01% | 99.99% |
| ND4-DdCBE_replicate1 | G | 99.93% | 0.01% | 99.97% | 0.01% | 0.02% | 0.00% | 0.00% | 0.00% |
| ND4-DdCBE_replicate 1 | N | 0.00% | 0.00% | 0.00% | 0.00% | 0.00% | 0.00% | 0.00% | 0.00% |
| ND4-DdCBE_replicate1 | — | 0.01% | 0.00% | 0.00% | 0.00% | 0.00% | 0.00% | 0.00% | 0.00% |
| ND4-DdCBE_replicate2 | A | 0.01% | 99.95% | 0.01% | 99.96% | 99.98% | 0.02% | 0.00% | 0.01% |
| ND4-DdCBE_replicate2 | T | 0.04% | 0.02% | 0.03% | 0.01% | 0.01% | 0.01% | 99.99% | 0.00% |
| ND4 DdCBE_replicate2 | C | 0.00% | 0.02% | 0.00% | 0.01% | 0.00% | 99.98% | 0.01% | 99.99% |
| ND4 DdCBE_replicate2 | G | 99.93% | 0.02% | 99.96% | 0.02% | 0.01% | 0.00% | 0.00% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.01% | 0.00% | 0.00% | 0.00% | 0.00% | 0.00% | 0.00% | 0.00% |
| ND4 DdCBE_replicate3 | A | 0.03% | 99.97% | 0.00% | 99.96% | 99.98% | 0.01% | 0.00% | 0.00% |
| ND4 DdCBE_replicate3 | T | 0.03% | 0.01% | 0.01% | 0.01% | 0.01% | 0.01% | 99.98% | 0.01% |
| ND4-DdCBE_replicate3 | C | 0.00% | 0.01% | 0.00% | 0.01% | 0.00% | 99.99% | 0.02% | 99.98% |
| ND4-DdCBE_replicate3 | G | 99.93% | 0.01% | 99.98% | 0.01% | 0.01% | 0.00% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | | 0.01% | 0.00% | 0.00% | 0.00% | 0.00% | 0.00% | 0.00% | 0.00% |
| Batch | Nucleotide | C | G | T | T | C | T | C | C |
| ND4-DdCBE_replicate 1 | A | 0.00% | 0.25% | 0.00% | 0.00% | 0.01% | 0.01% | 0.01% | 0.02% |
| ND4-DdCBE_replicate1 | T | 0.02% | 0.00% | 99.96% | 99.98% | 0.01% | 99.98% | 0.02% | 0.01% |
| ND4-DdCBE_replicate1 | C | 99.98% | 0.00% | 0.03% | 0.01% | 99.99% | 0.01% | 99.97% | 99.97% |
| ND4-DdCBE_replicate1 | G | 0.00% | 99.75% | 0.01% | 0.00% | 0.00% | 0.00% | 0.00% | 0.00% |

TABLE 12E-continued

| | | | | | | | | | |
|---|---|---|---|---|---|---|---|---|---|
| Base Percentages at TALE Binding Sites-ND4-DdCBE | | | | | | | | | |
| ND4-DdCBE_replicate1 | N | 0.00% | 0.00% | 0.00% | 0.00% | 0.00% | 0.00% | 0.00% | 0.00% |
| ND4-DdCBE_replicate1 | — | 0.00% | 0.00% | 0.00% | 0.00% | 0.00% | 0.00% | 0.00% | 0.00% |
| ND4-DdCBE_replicate2 | A | 0.00% | 0.24% | 0.00% | 0.00% | 0.00% | 0.01% | 0.01% | 0.03% |
| ND4-DdCBE_replicate2 | T | 0.03% | 0.01% | 99.97% | 99.99% | 0.00% | 99.97% | 0.03% | 0.01% |
| ND4-DdCBE_replicate2 | C | 99.97% | 0.00% | 0.03% | 0.01% | 99.99% | 0.02% | 99.96% | 99.96% |
| ND4-DdCBE_replicate2 | G | 0.00% | 99.75% | 0.00% | 0.00% | 0.00% | 0.00% | 0.00% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4-DdCBE_replicate3 | A | 0.01% | 0.23% | 0.00% | 0.01% | 0.00% | 0.01% | 0.01% | 0.02% |
| ND4-DdCBE_replicate3 | T | 0.02% | 0.00% | 99.96% | 99.99% | 0.00% | 99.99% | 0.01% | 0.01% |
| ND4-DdCBE_replicate3 | C | 99.97% | 0.00% | 0.03% | 0.01% | 99.99% | 0.00% | 99.98% | 99.97% |
| ND4-DdCBE_replicate3 | G | 0.00% | 99.76% | 0.00% | 0.00% | 0.00% | 0.00% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.00% | 0.00% | 0.00% | 0.00% |
| Batch | Nucleotide | T | C | C | T | A | C | T | T |
| ND4-DdCBE_replicate 1 | A | 0.01% | 0.01% | 0.01% | 0.01% | 99.97% | 0.01% | 0.01% | 0.01% |
| ND4-DdCBE_replicate1 | T | 99.98% | 0.01% | 0.02% | 99.98% | 0.01% | 0.01% | 99.98% | 99.97% |
| ND4-DdCBE_replicate 1 | C | 0.01% | 99.98% | 99.97% | 0.01% | 0.02% | 99.99% | 0.01% | 0.01% |
| ND4-DdCBE_replicate 1 | G | 0.00% | 0.00% | 0.00% | 0.00% | 0.01% | 0.00% | 0.00% | 0.00% |
| ND4-DdCBE_replicate 1 | N | 0.00% | 0.00% | 0.00% | 0.00% | 0.00% | 0.00% | 0.00% | 0.00% |
| ND4-DdCBE_replicate 1 | | 0.00% | 0.00% | 0.00% | 0.00% | 0.00% | 0.00% | 0.00% | 0.01% |
| ND4-DdCBE_replicate2 | A | 0.02% | 0.01% | 0.01% | 0.02% | 99.96% | 0.00% | 0.01% | 0.00% |
| ND4-DdCBE_replicate2 | T | 99.97% | 0.00% | 0.02% | 99.97% | 0.01% | 0.00% | 99.99% | 99.98% |
| ND4-DdCBE_replicate2 | C | 0.00% | 99.99% | 99.97% | 0.01% | 0.02% | 100.00% | 0.01% | 0.01% |
| ND4-DdCBE_replicate2 | G | 0.01% | 0.00% | 0.01% | 0.00% | 0.01% | 0.00% | 0.00% | 0.00% |
| ND4-DdCBE_replicate2 | N | 0.00% | 0.00% | 0.00% | 0.00% | 0.00% | 0.00% | 0.00% | 0.00% |

TABLE 12E-continued

| Base Percentages at TALE Binding Sites-ND4-DdCBE | | | | | | | | | |
|---|---|---|---|---|---|---|---|---|---|
| ND4-DdCBE_replicate2 | — | 0.00% | 0.00% | 0.00% | 0.00% | 0.00% | 0.00% | 0.00% | 0.01% |
| ND4-DdCBE_replicate3 | A | 0.01% | 0.02% | 0.00% | 0.01% | 99.97% | 0.00% | 0.01% | 0.01% |
| ND4-DdCBE_replicate3 | T | 99.97% | 0.01% | 0.02% | 99.98% | 0.01% | 0.01% | 99.98% | 99.96% |
| ND4-DdCBE_replicate3 | C | 0.02% | 99.98% | 99.97% | 0.01% | 0.01% | 99.99% | 0.01% | 0.01% |
| ND4-DdCBE_replicate3 | G | 0.00% | 0.00% | 0.00% | 0.00% | 0.01% | 0.00% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.00% | 0.00% | 0.00% | 0.01% |
| Batch | Nucleotide | T | A | G | T | C | A | C | A |
| ND4-DdCBE_replicate1 | A | 0.02% | 99.98% | 0.24% | 0.02% | 0.02% | 99.96% | 0.01% | 99.99% |
| ND4-DdCBE_replicate 1 | T | 99.97% | 0.00% | 0.01% | 99.95% | 0.03% | 0.01% | 0.01% | 0.00% |
| ND4-DdCBE_replicate 1 | C | 0.01% | 0.00% | 0.00% | 0.03% | 99.95% | 0.02% | 99.98% | 0.00% |
| ND4-DdCBE_replicate 1 | G | 0.00% | 0.02% | 99.76% | 0.00% | 0.00% | 0.01% | 0.00% | 0.01% |
| ND4-DdCBE_replicate1 | N | 0.00% | 0.00% | 0.00% | 0.00% | 0.00% | 0.00% | 0.00% | 0.00% |
| ND4-DdCBE_replicate1 | — | 0.00% | 0.00% | 0.00% | 0.00% | 0.00% | 0.00% | 0.00% | 0.00% |
| ND4-DdCBE_replicate2 | A | 0.01% | 99.97% | 0.23% | 0.02% | 0.03% | 99.96% | 0.00% | 99.99% |
| ND4-DdCBE_replicate2 | T | 99.97% | 0.01% | 0.01% | 99.92% | 0.05% | 0.01% | 0.01% | 0.00% |
| ND4-DdCBE_replicate2 | C | 0.01% | 0.00% | 0.00% | 0.06% | 99.92% | 0.01% | 99.98% | 0.00% |
| ND4-DdCBE_replicate2 | G | 0.00% | 0.02% | 99.77% | 0.00% | 0.00% | 0.02% | 0.00% | 0.01% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4-DdCBE_replicate3 | A | 0.01% | 99.99% | 0.21% | 0.02% | 0.02% | 99.97% | 0.01% | 99.98% |
| ND4-DdCBE_replicate3 | T | 99.97% | 0.01% | 0.01% | 99.93% | 0.03% | 0.01% | 0.01% | 0.00% |
| ND4-DdCBE_replicate3 | C | 0.02% | 0.00% | 0.00% | 0.05% | 99.95% | 0.00% | 99.98% | 0.00% |
| ND4-DdCBE_replicate3 | G | 0.00% | 0.01% | 99.78% | 0.00% | 0.00% | 0.01% | 0.00% | 0.01% |
| ND4-DdCBE_replicate3 | N | 0.00% | 0.00% | 0.00% | 0.00% | 0.00% | 0.00% | 0.00% | 0.00% |

TABLE 12E-continued

| Base Percentages at TALE Binding Sites-ND4-DdCBE | | | | | | | | | |
|---|---|---|---|---|---|---|---|---|---|
| ND4-DdCBE_replicate3 | — | 0.00% | 0.00% | 0.00% | 0.00% | 0.00% | 0.00% | 0.00% | 0.00% |
| Batch | Nucleotide | T | C | T | G | T | G | C | T |
| ND4-DdCBE_replicate 1 | A | 0.01% | 0.01% | 0.01% | 0.02% | 0.02% | 0.01% | 0.01% | 0.00% |
| ND4-DdCBE_replicate1 | T | 99.98% | 0.01% | 99.97% | 0.00% | 99.96% | 0.00% | 0.01% | 99.98% |
| ND4-DdCBE_replicate 1 | C | 0.01% | 99.97% | 0.01% | 0.00% | 0.01% | 0.00% | 99.98% | 0.01% |
| ND4-DdCBE_replicate1 | G | 0.00% | 0.01% | 0.00% | 99.98% | 0.01% | 99.98% | 0.00% | 0.00% |
| ND4-DdCBE_replicate 1 | N | 0.00% | 0.00% | 0.00% | 0.00% | 0.00% | 0.00% | 0.00% | 0.00% |
| ND4-DdCBE_replicate1 | — | 0.00% | 0.00% | 0.00% | 0.00% | 0.00% | 0.00% | 0.00% | 0.00% |
| ND4-DdCBE_replicate2 | A | 0.01% | 0.01% | 0.01% | 0.01% | 0.02% | 0.01% | 0.01% | 0.00% |
| ND4-DdCBE_replicate2 | T | 99.98% | 0.01% | 99.98% | 0.00% | 99.96% | 0.01% | 0.01% | 99.99% |
| ND4 DdCBE_replicate2 | C | 0.01% | 99.97% | 0.01% | 0.00% | 0.01% | 0.01% | 99.99% | 0.01% |
| ND4 DdCBE_replicate2 | G | 0.00% | 0.00% | 0.00% | 99.99% | 0.01% | 99.97% | 0.00% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |
| ND4 DdCBE_replicate3 | A | 0.01% | 0.01% | 0.01% | 0.01% | 0.01% | 0.01% | 0.01% | 0.01% |
| ND4 DdCBE_replicate3 | T | 99.97% | 0.01% | 99.98% | 0.01% | 99.95% | 0.01% | 0.01% | 99.98% |
| ND4-DdCBE_replicate3 | C | 0.01% | 99.97% | 0.01% | 0.00% | 0.02% | 0.01% | 99.98% | 0.01% |
| ND4-DdCBE_replicate3 | G | 0.00% | 0.01% | 0.00% | 99.98% | 0.01% | 99.97% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | | 0.00% | 0.00% | 0.00% | 0.00% | 0.00% | 0.00% | 0.00% | 0.00% |
| Batch | Nucleotide | T | G | A | T | C | A | A | A |
| ND4-DdCBE_replicate 1 | A | 0.00% | 47.28% | 99.97% | 0.01% | 0.01% | 99.96% | 99.98% | 99.98% |
| ND4-DdCBE_replicate1 | T | 99.98% | 0.01% | 0.02% | 99.98% | 0.37% | 0.01% | 0.01% | 0.01% |
| ND4-DdCBE_replicate1 | C | 0.01% | 0.00% | 0.00% | 0.01% | 99.61% | 0.00% | 0.00% | 0.00% |
| ND4-DdCBE_replicate1 | G | 0.00% | 52.70% | 0.01% | 0.00% | 0.00% | 0.02% | 0.01% | 0.01% |
| ND4-DdCBE_replicate1 | N | 0.00% | 0.00% | 0.00% | 0.00% | 0.00% | 0.00% | 0.00% | 0.00% |

TABLE 12E-continued

| Base Percentages at TALE Binding Sites-ND4-DdCBE | | | | | | | | | |
|---|---|---|---|---|---|---|---|---|---|
| ND4-DdCBE_replicate1 | — | 0.00% | 0.01% | 0.00% | 0.00% | 0.00% | 0.01% | 0.00% | 0.00% |
| ND4-DdCBE_replicate2 | A | 0.01% | 47.37% | 99.98% | 0.01% | 0.01% | 99.97% | 99.99% | 99.98% |
| ND4-DdCBE_replicate2 | T | 99.98% | 0.00% | 0.01% | 99.99% | 0.43% | 0.00% | 0.00% | 0.01% |
| ND4-DdCBE_replicate2 | C | 0.01% | 0.00% | 0.01% | 0.01% | 99.56% | 0.00% | 0.00% | 0.00% |
| ND4-DdCBE_replicate2 | G | 0.00% | 52.62% | 0.00% | 0.00% | 0.00% | 0.01% | 0.01% | 0.01% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.01% | 0.00% | 0.00% | 0.00% | 0.01% | 0.00% | 0.00% |
| ND4-DdCBE_replicate3 | A | 0.01% | 43.55% | 99.97% | 0.01% | 0.00% | 99.97% | 99.97% | 99.98% |
| ND4-DdCBE_replicate3 | T | 99.98% | 0.00% | 0.02% | 99.99% | 0.36% | 0.00% | 0.01% | 0.00% |
| ND4-DdCBE_replicate3 | C | 0.01% | 0.01% | 0.00% | 0.01% | 99.64% | 0.01% | 0.01% | 0.00% |
| ND4-DdCBE_replicate3 | G | 0.00% | 56.43% | 0.01% | 0.00% | 0.00% | 0.01% | 0.02% | 0.01% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.00% | 0.00% | 0.00% | 0.00% | 0.01% | 0.00% | 0.00% |
| Batch | Nucleotide | A | C | A | G | G | A | C | T |
| ND4-DdCBE_replicate 1 | A | 99.96% | 0.01% | 99.96% | 0.01% | 0.01% | 99.93% | 0.01% | 0.01% |
| ND4-DdCBE_replicate1 | T | 0.00% | 0.01% | 0.01% | 0.02% | 0.01% | 0.00% | 0.01% | 99.97% |
| ND4-DdCBE_replicate 1 | C | 0.03% | 99.98% | 0.00% | 0.00% | 0.00% | 0.05% | 99.98% | 0.02% |
| ND4-DdCBE_replicate 1 | G | 0.01% | 0.00% | 0.03% | 99.97% | 99.98% | 0.02% | 0.00% | 0.00% |
| ND4-DdCBE_replicate 1 | N | 0.00% | 0.00% | 0.00% | 0.00% | 0.00% | 0.00% | 0.00% | 0.00% |
| ND4-DdCBE_replicate 1 | | 0.00% | 0.00% | 0.00% | 0.00% | 0.00% | 0.00% | 0.00% | 0.00% |
| ND4-DdCBE_replicate2 | A | 99.95% | 0.01% | 99.97% | 0.01% | 0.01% | 99.94% | 0.00% | 0.01% |
| ND4-DdCBE_replicate2 | T | 0.01% | 0.01% | 0.01% | 0.02% | 0.00% | 0.01% | 0.01% | 99.98% |
| ND4-DdCBE_replicate2 | C | 0.02% | 99.98% | 0.01% | 0.00% | 0.01% | 0.05% | 99.99% | 0.01% |
| ND4-DdCBE_replicate2 | G | 0.01% | 0.00% | 0.01% | 99.97% | 99.98% | 0.00% | 0.00% | 0.00% |
| ND4-DdCBE_replicate2 | N | 0.00% | 0.00% | 0.00% | 0.00% | 0.00% | 0.00% | 0.00% | 0.00% |
| ND4-DdCBE_replicate2 | — | 0.00% | 0.00% | 0.00% | 0.00% | 0.00% | 0.00% | 0.00% | 0.00% |

TABLE 12E-continued

| Base Percentages at TALE Binding Sites-ND4-DdCBE | | | | | | | | | |
|---|---|---|---|---|---|---|---|---|---|
| ND4-DdCBE_replicate3 | A | 99.96% | 0.01% | 99.97% | 0.02% | 0.01% | 99.92% | 0.00% | 0.01% |
| ND4-DdCBE_replicate3 | T | 0.00% | 0.01% | 0.00% | 0.01% | 0.01% | 0.01% | 0.01% | 99.98% |
| ND4-DdCBE_replicate3 | C | 0.03% | 99.98% | 0.00% | 0.00% | 0.00% | 0.06% | 99.99% | 0.02% |
| ND4-DdCBE_replicate3 | G | 0.01% | 0.00% | 0.02% | 99.97% | 99.98% | 0.01% | 0.00% | 0.00% |
| ND4-DdCBE_replicate3 | N | 0.00% | 0.00% | 0.00% | 0.00% | 0.00% | 0.00% | 0.00% | 0.00% |
| ND4-DdCBE_replicate3 | — | 0.00% | 0.01% | 0.01% | 0.00% | 0.00% | 0.00% | 0.00% | 0.00% |

| Batch | Nucleotide | G | C |
|---|---|---|---|
| ND4-DdCBE_replicate1 | A | 0.02% | 0.01% |
| ND4-DdCBE_replicate 1 | T | 0.01% | 0.01% |
| ND4-DdCBE_replicate 1 | C | 0.01% | 99.8% |
| ND4-DdCBE_replicate 1 | G | 99.96% | 0.00% |
| ND4-DdCBE_replicate1 | N | 0.00% | 0.00% |
| ND4-DdCBE_replicate1 | — | 0.00% | 0.00% |
| ND4-DdCBE_replicate2 | A | 0.01% | 0.00% |
| ND4-DdCBE_replicate2 | T | 0.01% | 0.01% |
| ND4-DdCBE_replicate2 | C | 0.00% | 99.99% |
| ND4-DdCBE_replicate2 | G | 99.98% | 0.00% |
| ND4-DdCBE_replicate2 | N | 0.00% | 0.00% |
| ND4-DdCBE_replicate2 | — | 0.00% | 0.00% |
| ND4-DdCBE_replicate3 | A | 0.02% | 0.01% |
| ND4-DdCBE_replicate3 | T | 0.01% | 0.00% |
| ND4-DdCBE_replicate3 | C | 0.00% | 99.99% |
| ND4-DdCBE_replicate3 | G | 99.97% | 0.00% |
| ND4-DdCBE_replicate3 | N | 0.00% | 0.00% |
| ND4-DdCBE_replicate3 | — | 0.00% | 0.00% |

TABLE 12F

| Base Percentages at TALE Binding Sites-ND2-DdCBE | | | | | | | | | |
|---|---|---|---|---|---|---|---|---|---|
| Batch | Nucleotide | C | C | A | A | A | C | C | C |
| ND2-DdCBE_replicate 1 | A | 0.01% | 0.01% | 99.98% | 99.99% | 99.97% | 0.02% | 0.02% | 0.01% |
| ND2-DdCBE_replicate 1 | T | 0.02% | 0.01% | 0.00% | 0.00% | 0.00% | 0.00% | 0.01% | 0.04% |
| ND2-DdCBE_replicate1 | C | 99.97% | 99.97% | 0.00% | 0.00% | 0.01% | 99.97% | 99.97% | 99.95% |
| ND2-DdCBE_replicate 1 | G | 0.00% | 0.00% | 0.02% | 0.01% | 0.01% | 0.00% | 0.00% | 0.00% |
| ND2-DdCBE_replicate 1 | N | 0.00% | 0.00% | 0.00% | 0.00% | 0.00% | 0.00% | 0.00% | 0.00% |
| ND2-DdCBE_replicate1 | — | 0.00% | 0.00% | 0.00% | 0.00% | 0.01% | 0.00% | 0.00% | 0.00% |
| ND2-DdCBE_replicate2 | A | 0.00% | 0.01% | 99.98% | 99.97% | 99.98% | 0.03% | 0.00% | 0.00% |
| ND2-DdCBE_replicate2 | T | 0.01% | 0.02% | 0.00% | 0.00% | 0.00% | 0.00% | 0.02% | 0.04% |
| ND2-DdCBE_replicate2 | C | 99.98% | 99.96% | 0.01% | 0.02% | 0.00% | 99.96% | 99.98% | 99.95% |
| ND2-DdCBE_replicate2 | G | 0.00% | 0.00% | 0.02% | 0.01% | 0.01% | 0.00% | 0.00% | 0.00% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 0.00% | 0.01% | 99.99% | 99.98% | 99.98% | 0.02% | 0.01% | 0.01% |
| ND2-DdCBE_replicate3 | T | 0.01% | 0.01% | 0.00% | 0.00% | 0.00% | 0.02% | 0.01% | 0.03% |
| ND2-DdCBE_replicate3 | C | 99.99% | 99.97% | 0.00% | 0.01% | 0.01% | 99.96% | 99.99% | 99.96% |
| ND2-DdCBE_replicate3 | G | 0.00% | 0.00% | 0.01% | 0.01% | 0.01% | 0.00% | 0.00% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.01% | 0.00% | 0.00% | 0.00% |
| Batch | Nucleotide | A | G | C | A | T | A | C | T |
| ND2-DdCBE_replicate1 | A | 99.98% | 0.02% | 0.01% | 99.98% | 0.01% | 99.97% | 0.00% | 0.01% |
| ND2-DdCBE_replicate1 | T | 0.00% | 0.01% | 0.02% | 0.01% | 99.97% | 0.01% | 0.01% | 99.97% |
| ND2-DdCBE_replicate1 | C | 0.00% | 0.00% | 99.97% | 0.00% | 0.01% | 0.01% | 99.99% | 0.02% |
| ND2-DdCBE_replicate1 | G | 0.02% | 99.97% | 0.00% | 0.01% | 0.00% | 0.01% | 0.00% | 0.01% |
| ND2-DdCBE_replicate 1 | N | 0.00% | 0.00% | 0.00% | 0.00% | 0.00% | 0.00% | 0.00% | 0.00% |
| ND2-DdCBE_replicate 1 | — | 0.00% | 0.00% | 0.00% | 0.00% | 0.00% | 0.00% | 0.00% | 0.00% |

TABLE 12F-continued

| Base Percentages at TALE Binding Sites-ND2-DdCBE | | | | | | | | | |
|---|---|---|---|---|---|---|---|---|---|
| ND2-DdCBE_replicate2 | A | 99.98% | 0.01% | 0.00% | 99.97% | 0.00% | 99.98% | 0.01% | 0.01% |
| ND2-DdCBE_replicate2 | T | 0.00% | 0.01% | 0.02% | 0.01% | 99.98% | 0.01% | 0.00% | 99.97% |
| ND2-DdCBE_replicate2 | C | 0.00% | 0.01% | 99.97% | 0.00% | 0.01% | 0.00% | 99.98% | 0.01% |
| ND2-DdCBE_replicate2 | G | 0.01% | 99.97% | 0.00% | 0.02% | 0.01% | 0.00% | 0.00% | 0.01% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 99.98% | 0.01% | 0.01% | 99.96% | 0.01% | 99.97% | 0.02% | 0.01% |
| ND2-DdCBE_replicate3 | T | 0.00% | 0.02% | 0.02% | 0.02% | 99.99% | 0.01% | 0.00% | 99.97% |
| ND2-DdCBE_replicate3 | C | 0.00% | 0.00% | 99.98% | 0.00% | 0.00% | 0.01% | 99.98% | 0.01% |
| ND2-DdCBE_replicate3 | G | 0.01% | 99.97% | 0.00% | 0.02% | 0.00% | 0.01% | 0.00% | 0.01% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.00% | 0.00% | 0.00% | 0.00% |
| Batch | Nucleotide | A | G | G | A | T | G | A | A |
| ND2-DdCBE_replicate 1 | A | 100.00% | 0.29% | 4.82% | 99.95% | 0.00% | 0.05% | 99.97% | 99.94% |
| ND2-DdCBE_replicate 1 | T | 0.00% | 0.02% | 0.01% | 0.01% | 99.99% | 0.02% | 0.01% | 0.02% |
| ND2-DdCBE_replicate 1 | C | 0.00% | 0.00% | 0.00% | 0.01% | 0.01% | 0.00% | 0.00% | 0.01% |
| ND2-DdCBE_replicate 1 | G | 0.00% | 99.69% | 95.18% | 0.02% | 0.00% | 99.93% | 0.02% | 0.02% |
| ND2-DdCBE_replicate1 | N | 0.00% | 0.00% | 0.00% | 0.00% | 0.00% | 0.00% | 0.00% | 0.00% |
| ND2-DdCBE_replicate 1 | — | 0.00% | 0.00% | 0.00% | 0.00% | 0.00% | 0.00% | 0.00% | 0.00% |
| ND2-DdCBE_replicate2 | A | 99.99% | 0.35% | 4.74% | 99.97% | 0.00% | 0.04% | 99.98% | 99.96% |
| ND2-DdCBE_replicate2 | T | 0.00% | 0.02% | 0.00% | 0.01% | 99.98% | 0.01% | 0.01% | 0.01% |
| ND2-DdCBE_replicate2 | C | 0.00% | 0.00% | 0.01% | 0.02% | 0.01% | 0.00% | 0.00% | 0.01% |
| ND2-DdCBE_replicate2 | G | 0.01% | 99.64% | 95.25% | 0.00% | 0.00% | 99.95% | 0.01% | 0.02% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 99.99% | 0.33% | 4.37% | 99.98% | 0.01% | 0.05% | 99.97% | 99.98% |

TABLE 12F-continued

| Base Percentages at TALE Binding Sites-ND2-DdCBE | | | | | | | | | |
|---|---|---|---|---|---|---|---|---|---|
| ND2-DdCBE_replicate3 | T | 0.01% | 0.02% | 0.01% | 0.00% | 99.97% | 0.01% | 0.01% | 0.01% |
| ND2-DdCBE_replicate3 | C | 0.00% | 0.01% | 0.01% | 0.01% | 0.01% | 0.01% | 0.00% | 0.00% |
| ND2-DdCBE_replicate3 | G | 0.01% | 99.65% | 95.61% | 0.01% | 0.01% | 99.93% | 0.02% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.00% | 0.00% | 0.00% | 0.00% |
| Batch | Nucleotide | G | T | A | C | A | A | C | C |
| ND2-DdCBE_replicate 1 | A | 0.01% | 0.01% | 99.98% | 0.01% | 99.99% | 99.98% | 0.01% | 0.02% |
| ND2-DdCBE_replicate 1 | T | 0.00% | 99.94% | 0.01% | 0.02% | 0.00% | 0.01% | 0.02% | 0.01% |
| ND2-DdCBE_replicate 1 | C | 0.00% | 0.05% | 0.00% | 99.97% | 0.01% | 0.00% | 99.97% | 99.98% |
| ND2-DdCBE_replicate 1 | G | 99.98% | 0.01% | 0.01% | 0.00% | 0.01% | 0.01% | 0.00% | 0.00% |
| ND2-DdCBE_replicate1 | N | 0.00% | 0.00% | 0.00% | 0.00% | 0.00% | 0.00% | 0.00% | 0.00% |
| ND2-DdCBE_replicate1 | — | 0.00% | 0.00% | 0.00% | 0.00% | 0.00% | 0.00% | 0.00% | 0.00% |
| ND2-DdCBE_replicate2 | A | 0.02% | 0.01% | 99.97% | 0.00% | 99.99% | 99.98% | 0.00% | 0.02% |
| ND2-DdCBE_replicate2 | T | 0.02% | 99.95% | 0.01% | 0.02% | 0.00% | 0.01% | 0.02% | 0.02% |
| ND2-DdCBE_replicate2 | C | 0.00% | 0.05% | 0.01% | 99.98% | 0.00% | 0.00% | 99.98% | 99.96% |
| ND2-DdCBE_replicate2 | G | 99.96% | 0.00% | 0.01% | 0.00% | 0.01% | 0.00% | 0.00% | 0.00% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 0.04% | 0.01% | 99.97% | 0.01% | 99.98% | 99.97% | 0.00% | 0.02% |
| ND2-DdCBE_replicate3 | T | 0.01% | 99.95% | 0.02% | 0.01% | 0.00% | 0.01% | 0.00% | 0.01% |
| ND2-DdCBE_replicate3 | C | 0.00% | 0.04% | 0.00% | 99.98% | 0.01% | 0.01% | 99.99% | 99.97% |
| ND2-DdCBE_replicate3 | G | 99.95% | 0.00% | 0.01% | 0.00% | 0.01% | 0.01% | 0.00% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.00% | 0.00% | 0.00% | 0.00% |
| Batch | Nucleotide | A | G | C | T | A | C | G | C |
| ND2-DdCBE_replicate 1 | A | 99.97% | 0.18% | 0.00% | 0.00% | 99.98% | 0.01% | 0.03% | 0.01% |

TABLE 12F-continued

| Base Percentages at TALE Binding Sites-ND2-DdCBE | | | | | | | | | |
|---|---|---|---|---|---|---|---|---|---|
| ND2-DdCBE_replicate 1 | T | 0.01% | 0.02% | 0.01% | 99.98% | 0.01% | 0.02% | 0.01% | 0.01% |
| ND2-DdCBE_replicate1 | C | 0.00% | 0.00% | 99.99% | 0.02% | 0.01% | 99.98% | 0.01% | 99.99% |
| ND2-DdCBE_replicate 1 | G | 0.01% | 99.80% | 0.00% | 0.00% | 0.01% | 0.00% | 99.95% | 0.00% |
| ND2-DdCBE_replicate 1 | N | 0.00% | 0.00% | 0.00% | 0.00% | 0.00% | 0.00% | 0.00% | 0.00% |
| ND2-DdCBE_replicate1 | — | 0.00% | 0.00% | 0.00% | 0.00% | 0.00% | 0.00% | 0.00% | 0.00% |
| ND2-DdCBE_replicate2 | A | 99.97% | 0.20% | 0.01% | 0.00% | 99.99% | 0.00% | 0.05% | 0.01% |
| ND2-DdCBE_replicate2 | T | 0.02% | 0.02% | 0.02% | 99.99% | 0.00% | 0.01% | 0.01% | 0.01% |
| ND2-DdCBE_replicate2 | C | 0.00% | 0.00% | 99.98% | 0.01% | 0.00% | 99.99% | 0.01% | 99.98% |
| ND2-DdCBE_replicate2 | G | 0.00% | 99.78% | 0.00% | 0.00% | 0.00% | 0.00% | 99.93% | 0.00% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 99.96% | 0.14% | 0.00% | 0.00% | 99.98% | 0.00% | 0.08% | 0.00% |
| ND2-DdCBE_replicate3 | T | 0.02% | 0.03% | 0.00% | 99.99% | 0.01% | 0.01% | 0.02% | 0.01% |
| ND2-DdCBE_replicate3 | C | 0.01% | 0.00% | 99.99% | 0.01% | 0.00% | 99.99% | 0.01% | 99.98% |
| ND2-DdCBE_replicate3 | G | 0.02% | 99.83% | 0.00% | 0.00% | 0.01% | 0.00% | 99.90% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.00% | 0.00% | 0.00% | 0.00% |

| Batch | Nucleotide | C | C | T | C | A | A | T | T |
|---|---|---|---|---|---|---|---|---|---|
| ND2-DdCBE_replicate1 | A | 0.03% | 0.01% | 0.01% | 0.00% | 99.96% | 99.98% | 0.01% | 0.01% |
| ND2-DdCBE_replicate1 | T | 0.02% | 0.01% | 99.98% | 0.31% | 0.01% | 0.00% | 99.99% | 99.98% |
| ND2-DdCBE_replicate1 | C | 99.96% | 99.99% | 0.01% | 99.68% | 0.00% | 0.02% | 0.00% | 0.01% |
| ND2-DdCBE_replicate1 | G | 0.00% | 0.00% | 0.00% | 0.00% | 0.03% | 0.00% | 0.00% | 0.00% |
| ND2-DdCBE_replicate 1 | N | 0.00% | 0.00% | 0.00% | 0.00% | 0.00% | 0.00% | 0.00% | 0.00% |
| ND2-DdCBE_replicate 1 | — | 0.00% | 0.00% | 0.00% | 0.00% | 0.00% | 0.00% | 0.00% | 0.01% |
| ND2-DdCBE_replicate2 | A | 0.01% | 0.01% | 0.00% | 0.00% | 99.95% | 99.98% | 0.01% | 0.01% |
| ND2-DdCBE_replicate2 | T | 0.03% | 0.01% | 99.97% | 0.33% | 0.01% | 0.01% | 99.98% | 99.97% |

TABLE 12F-continued

| Base Percentages at TALE Binding Sites-ND2-DdCBE | | | | | | | | | |
|---|---|---|---|---|---|---|---|---|---|
| ND2-DdCBE_ replicate2 | C | 99.95% | 99.98% | 0.02% | 99.66% | 0.00% | 0.01% | 0.01% | 0.02% |
| ND2-DdCBE_ replicate2 | G | 0.00% | 0.00% | 0.01% | 0.00% | 0.04% | 0.00% | 0.00% | 0.00% |
| ND2-DdCBE_ replicate2 | N | 0.00% | 0.00% | 0.00% | 0.00% | 0.00% | 0.00% | 0.00% | 0.00% |
| ND2-DdCBE_ replicate2 | — | 0.00% | 0.00% | 0.00% | 0.00% | 0.00% | 0.00% | 0.00% | 0.00% |
| ND2-DdCBE_ replicate3 | A | 0.02% | 0.01% | 0.01% | 0.00% | 99.96% | 99.97% | 0.01% | 0.01% |
| ND2-DdCBE_ replicate3 | T | 0.03% | 0.01% | 99.98% | 0.33% | 0.01% | 0.01% | 99.98% | 99.98% |
| ND2-DdCBE_ replicate3 | C | 99.96% | 99.98% | 0.01% | 99.67% | 0.00% | 0.02% | 0.01% | 0.02% |
| ND2-DdCBE_ replicate3 | G | 0.00% | 0.00% | 0.01% | 0.00% | 0.03% | 0.01% | 0.00% | 0.00% |
| ND2-DdCBE_ replicate3 | N | 0.00% | 0.00% | 0.00% | 0.00% | 0.00% | 0.00% | 0.00% | 0.00% |
| ND2-DdCBE_ replicate3 | — | 0.00% | 0.00% | 0.00% | 0.00% | 0.00% | 0.00% | 0.00% | 0.00% |
| Batch | Nucleotide | T | A | A | T | A | G | C | A |
| ND2-DdCBE_ replicate 1 | A | 0.00% | 99.98% | 99.96% | 0.01% | 99.98% | 0.02% | 0.01% | 99.97% |
| ND2-DdCBE_ replicate 1 | T | 99.98% | 0.01% | 0.02% | 99.82% | 0.01% | 0.00% | 0.00% | 0.00% |
| ND2-DdCBE_ replicate 1 | C | 0.01% | 0.00% | 0.01% | 0.18% | 0.00% | 0.00% | 99.98% | 0.01% |
| ND2-DdCBE_ replicate 1 | G | 0.01% | 0.01% | 0.01% | 0.00% | 0.02% | 99.97% | 0.01% | 0.02% |
| ND2-DdCBE_ replicate1 | N | 0.00% | 0.00% | 0.00% | 0.00% | 0.00% | 0.00% | 0.00% | 0.00% |
| ND2-DdCBE_ replicate 1 | — | 0.00% | 0.00% | 0.00% | 0.00% | 0.00% | 0.00% | 0.00% | 0.00% |
| ND2-DdCBE_ replicate2 | A | 0.01% | 99.99% | 99.96% | 0.01% | 99.97% | 0.01% | 0.01% | 99.97% |
| ND2-DdCBE_ replicate2 | T | 99.97% | 0.00% | 0.02% | 99.79% | 0.00% | 0.01% | 0.02% | 0.01% |
| ND2-DdCBE_ replicate2 | C | 0.02% | 0.00% | 0.00% | 0.20% | 0.00% | 0.01% | 99.97% | 0.00% |
| ND2-DdCBE_ replicate2 | G | 0.00% | 0.01% | 0.01% | 0.00% | 0.02% | 99.97% | 0.00% | 0.02% |
| ND2-DdCBE_ replicate2 | N | 0.00% | 0.00% | 0.00% | 0.00% | 0.00% | 0.00% | 0.00% | 0.00% |
| ND2-DdCBE_ replicate2 | — | 0.00% | 0.00% | 0.00% | 0.00% | 0.00% | 0.00% | 0.00% | 0.00% |
| ND2-DdCBE_ replicate3 | A | 0.00% | 99.99% | 99.96% | 0.00% | 99.98% | 0.01% | 0.00% | 99.97% |
| ND2-DdCBE_ replicate3 | T | 99.98% | 0.00% | 0.02% | 99.84% | 0.01% | 0.01% | 0.02% | 0.00% |
| ND2-DdCBE_ replicate3 | C | 0.01% | 0.00% | 0.01% | 0.16% | 0.00% | 0.01% | 99.97% | 0.01% |

TABLE 12F-continued

| Base Percentages at TALE Binding Sites-ND2-DdCBE | | | | | | | | | |
|---|---|---|---|---|---|---|---|---|---|
| ND2-DdCBE_replicate3 | G | 0.00% | 0.01% | 0.01% | 0.00% | 0.01% | 99.97% | 0.01% | 0.02% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.01% | 0.00% | 0.00% | 0.00% | 0.00% | 0.00% |
| Batch | Nucleotide | C | T | A | A | C | A | T | A |
| ND2-DdCBE_replicate 1 | A | 0.00% | 0.01% | 99.97% | 99.96% | 0.01% | 99.96% | 0.01% | 99.97% |
| ND2-DdCBE_replicate 1 | T | 0.02% | 99.98% | 0.00% | 0.01% | 0.01% | 0.02% | 99.98% | 0.01% |
| ND2-DdCBE_replicate 1 | C | 99.98% | 0.01% | 0.01% | 0.01% | 99.98% | 0.00% | 0.01% | 0.01% |
| ND2-DdCBE_replicate 1 | G | 0.01% | 0.00% | 0.02% | 0.01% | 0.00% | 0.01% | 0.00% | 0.00% |
| ND2-DdCBE_replicate1 | N | 0.00% | 0.00% | 0.00% | 0.00% | 0.00% | 0.00% | 0.00% | 0.00% |
| ND2-DdCBE_replicate1 | — | 0.00% | 0.00% | 0.00% | 0.01% | 0.00% | 0.00% | 0.00% | 0.00% |
| ND2-DdCBE_replicate2 | A | 0.01% | 0.00% | 99.96% | 99.98% | 0.01% | 99.97% | 0.00% | 99.98% |
| ND2-DdCBE_replicate2 | T | 0.02% | 99.98% | 0.00% | 0.00% | 0.01% | 0.01% | 99.99% | 0.00% |
| ND2-DdCBE_replicate2 | C | 99.97% | 0.02% | 0.00% | 0.01% | 99.98% | 0.00% | 0.00% | 0.01% |
| ND2-DdCBE_replicate2 | G | 0.00% | 0.00% | 0.03% | 0.00% | 0.00% | 0.01% | 0.00% | 0.01% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.01% | 0.00% | 0.00% | 0.00% | 0.00% |
| ND2-DdCBE_replicate3 | A | 0.01% | 0.01% | 99.98% | 99.96% | 0.00% | 99.97% | 0.00% | 99.97% |
| ND2-DdCBE_replicate3 | T | 0.02% | 99.98% | 0.00% | 0.01% | 0.01% | 0.02% | 100.00% | 0.01% |
| ND2-DdCBE_replicate3 | C | 99.97% | 0.01% | 0.00% | 0.02% | 99.99% | 0.00% | 0.00% | 0.01% |
| ND2-DdCBE_replicate3 | G | 0.00% | 0.00% | 0.02% | 0.01% | 0.00% | 0.00% | 0.00% | 0.01% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.01% | 0.00% | 0.00% | 0.00% | 0.00% |
| Batch | Nucleotide | A | A | A | A | T | C | T | T |
| ND2-DdCBE_replicate 1 | A | 99.97% | 99.96% | 99.89% | 99.92% | 0.00% | 0.00% | 0.00% | 0.00% |
| ND2-DdCBE_replicate 1 | T | 0.02% | 0.02% | 0.02% | 0.00% | 99.99% | 0.00% | 100.00% | 99.98% |
| ND2-DdCBE_replicate1 | C | 0.00% | 0.01% | 0.07% | 0.06% | 0.01% | 99.99% | 0.00% | 0.02% |

TABLE 12F-continued

| Base Percentages at TALE Binding Sites-ND2-DdCBE | | | | | | | | | |
|---|---|---|---|---|---|---|---|---|---|
| ND2-DdCBE_replicate 1 | G | 0.01% | 0.02% | 0.02% | 0.02% | 0.00% | 0.01% | 0.00% | 0.00% |
| ND2-DdCBE_replicate 1 | N | 0.00% | 0.00% | 0.00% | 0.00% | 0.00% | 0.00% | 0.00% | 0.00% |
| ND2-DdCBE_replicate1 | — | 0.00% | 0.00% | 0.00% | 0.00% | 0.00% | 0.00% | 0.00% | 0.00% |
| ND2-DdCBE_replicate2 | A | 99.96% | 99.97% | 99.87% | 99.95% | 0.00% | 0.00% | 0.00% | 0.00% |
| ND2-DdCBE_replicate2 | T | 0.01% | 0.01% | 0.02% | 0.00% | 99.99% | 0.01% | 99.99% | 99.98% |
| ND2-DdCBE_replicate2 | C | 0.01% | 0.00% | 0.10% | 0.03% | 0.01% | 99.98% | 0.00% | 0.01% |
| ND2-DdCBE_replicate2 | G | 0.02% | 0.01% | 0.01% | 0.02% | 0.00% | 0.01% | 0.00% | 0.00% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.01% |
| ND2-DdCBE_replicate3 | A | 99.96% | 99.95% | 99.90% | 99.96% | 0.00% | 0.01% | 0.00% | 0.00% |
| ND2-DdCBE_replicate3 | T | 0.01% | 0.02% | 0.01% | 0.01% | 99.99% | 0.01% | 99.99% | 99.97% |
| ND2-DdCBE_replicate3 | C | 0.01% | 0.00% | 0.08% | 0.03% | 0.01% | 99.98% | 0.01% | 0.02% |
| ND2-DdCBE_replicate3 | G | 0.01% | 0.03% | 0.01% | 0.01% | 0.00% | 0.00% | 0.00% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.00% | 0.00% | 0.00% | 0.00% | 0.01% |
| Batch | Nucleotide | A | C | C | C | A | C | A | T |
| ND2-DdCBE_replicate1 | A | 99.98% | 0.01% | 0.00% | 0.02% | 99.96% | 0.01% | 99.99% | 0.00% |
| ND2-DdCBE_replicate1 | T | 0.01% | 0.01% | 0.02% | 0.01% | 0.02% | 0.74% | 0.01% | 99.99% |
| ND2-DdCBE_replicate1 | C | 0.00% | 99.98% | 99.97% | 99.96% | 0.00% | 99.25% | 0.00% | 0.01% |
| ND2-DdCBE_replicate1 | G | 0.01% | 0.00% | 0.01% | 0.01% | 0.02% | 0.00% | 0.00% | 0.00% |
| ND2-DdCBE_replicate 1 | N | 0.00% | 0.00% | 0.00% | 0.00% | 0.00% | 0.00% | 0.00% | 0.00% |
| ND2-DdCBE_replicate 1 | — | 0.01% | 0.00% | 0.00% | 0.00% | 0.01% | 0.00% | 0.00% | 0.00% |
| ND2-DdCBE_replicate2 | A | 99.98% | 0.01% | 0.00% | 0.02% | 99.97% | 0.00% | 99.97% | 0.00% |
| ND2-DdCBE_replicate2 | T | 0.01% | 0.01% | 0.01% | 0.02% | 0.01% | 0.79% | 0.01% | 99.99% |
| ND2-DdCBE_replicate2 | C | 0.00% | 99.98% | 99.98% | 99.95% | 0.01% | 99.20% | 0.01% | 0.01% |
| ND2-DdCBE_replicate2 | G | 0.01% | 0.00% | 0.00% | 0.00% | 0.01% | 0.00% | 0.02% | 0.00% |

TABLE 12F-continued

| Base Percentages at TALE Binding Sites-ND2-DdCBE | | | | | | | | | |
|---|---|---|---|---|---|---|---|---|---|
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 99.98% | 0.00% | 0.01% | 0.01% | 99.97% | 0.01% | 99.97% | 0.01% |
| ND2-DdCBE_replicate3 | T | 0.01% | 0.03% | 0.01% | 0.02% | 0.01% | 0.74% | 0.01% | 99.99% |
| ND2-DdCBE_replicate3 | C | 0.01% | 99.96% | 99.98% | 99.96% | 0.00% | 99.25% | 0.01% | 0.01% |
| ND2-DdCBE_replicate3 | G | 0.01% | 0.00% | 0.01% | 0.00% | 0.01% | 0.00% | 0.01% | 0.00% |
| ND2-DdCBE_replicate3 | N | 0.00% | 0.00% | 0.00% | 0.00% | 0.00% | 0.00% | 0.00% | 0.00% |
| ND2-DdCBE_replicate3 | — | 0.00% | 0.00% | 0.00% | 0.01% | 0.00% | 0.00% | 0.00% | 0.00% |
| Batch | Nucleotide | G | T | T | C | T | A | C | C |
| ND2-DdCBE_replicate 1 | A | 0.00% | 0.01% | 0.01% | 0.01% | 0.02% | 99.98% | 0.00% | 0.01% |
| ND2-DdCBE_replicate 1 | T | 0.01% | 99.97% | 99.98% | 0.01% | 99.97% | 0.01% | 0.02% | 0.02% |
| ND2-DdCBE_replicate 1 | C | 0.01% | 0.01% | 0.01% | 99.98% | 0.01% | 0.00% | 99.97% | 99.96% |
| ND2-DdCBE_replicate 1 | G | 99.98% | 0.01% | 0.00% | 0.00% | 0.00% | 0.01% | 0.00% | 0.00% |
| ND2-DdCBE_replicate1 | N | 0.00% | 0.00% | 0.00% | 0.00% | 0.00% | 0.00% | 0.00% | 0.00% |
| ND2-DdCBE_replicate 1 | — | 0.00% | 0.00% | 0.00% | 0.00% | 0.00% | 0.00% | 0.00% | 0.00% |
| ND2-DdCBE_replicate2 | A | 0.01% | 0.01% | 0.00% | 0.00% | 0.01% | 99.99% | 0.00% | 0.01% |
| ND2-DdCBE_replicate2 | T | 0.00% | 99.97% | 100.00% | 0.01% | 99.98% | 0.00% | 0.01% | 0.02% |
| ND2-DdCBE_replicate2 | C | 0.00% | 0.01% | 0.00% | 99.99% | 0.01% | 0.00% | 99.98% | 99.96% |
| ND2-DdCBE_replicate2 | G | 99.99% | 0.01% | 0.00% | 0.00% | 0.00% | 0.01% | 0.00% | 0.00% |
| ND2-DdCBE_replicate2 | N | 0.00% | 0.00% | 0.00% | 0.00% | 0.00% | 0.00% | 0.00% | 0.00% |
| ND2-DdCBE_replicate2 | — | 0.00% | 0.00% | 0.00% | 0.00% | 0.00% | 0.00% | 0.00% | 0.00% |
| ND2-DdCBE_replicate3 | A | 0.01% | 0.01% | 0.01% | 0.00% | 0.01% | 99.96% | 0.00% | 0.01% |
| ND2-DdCBE_replicate3 | T | 0.01% | 99.97% | 99.97% | 0.01% | 99.97% | 0.01% | 0.02% | 0.02% |
| ND2-DdCBE_replicate3 | C | 0.00% | 0.02% | 0.02% | 99.98% | 0.01% | 0.00% | 99.98% | 99.96% |
| ND2-DdCBE_replicate3 | G | 99.98% | 0.00% | 0.00% | 0.01% | 0.00% | 0.03% | 0.00% | 0.01% |
| ND2-DdCBE_replicate3 | N | 0.00% | 0.00% | 0.00% | 0.00% | 0.00% | 0.00% | 0.00% | 0.00% |

TABLE 12F-continued

| Base Percentages at TALE Binding Sites-ND2-DdCBE | | | | | | | | | |
|---|---|---|---|---|---|---|---|---|---|
| ND2-DdCBE_replicate3 | — | 0.00% | 0.00% | 0.00% | 0.00% | 0.00% | 0.00% | 0.00% | 0.00% |

| Batch | Nucleotide | A | C |
|---|---|---|---|
| ND2-DdCBE_replicate 1 | A | 99.96% | 0.00% |
| ND2-DdCBE_replicate 1 | T | 0.01% | 0.02% |
| ND2-DdCBE_replicate 1 | C | 0.01% | 99.98% |
| ND2-DdCBE_replicate 1 | G | 0.01% | 0.00% |
| ND2-DdCBE_replicate1 | N | 0.00% | 0.00% |
| ND2-DdCBE_replicate1 | — | 0.02% | 0.00% |
| ND2-DdCBE_replicate2 | A | 99.96% | 0.01% |
| ND2-DdCBE_replicate2 | T | 0.01% | 0.02% |
| ND2-DdCBE_replicate2 | C | 0.01% | 99.97% |
| ND2-DdCBE_replicate2 | G | 0.02% | 0.00% |
| ND2-DdCBE_replicate2 | N | 0.00% | 0.00% |
| ND2-DdCBE_replicate2 | — | 0.01% | 0.00% |
| ND2-DdCBE_replicate3 | A | 99.97% | 0.01% |
| ND2-DdCBE_replicate3 | T | 0.00% | 0.02% |
| ND2-DdCBE_replicate3 | C | 0.02% | 99.98% |
| ND2-DdCBE_replicate3 | G | 0.01% | 0.00% |
| ND2-DdCBE_replicate3 | N | 0.00% | 0.00% |
| ND2-DdCBE_replicate3 | — | 0.00% | 0.00% |

TABLE 12G

| Base Percentages at TALE Binding Sites-ND1-DdCBE | | | | | | | | | |
|---|---|---|---|---|---|---|---|---|---|
| Batch | Nucleotide | T | C | C | T | A | T | T | T |
| ND1-DdCBE_replicate1 | A | 0.00% | 0.03% | 0.00% | 0.00% | 99.56% | 0.00% | 0.00% | 0.00% |
| ND1-DdCBE_replicate1 | T | 99.97% | 0.12% | 0.00% | 99.91% | 0.09% | 99.97% | 100.00% | 100.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate1 | C | 0.03% | 99.85% | 100.00% | 0.09% | 0.35% | 0.03% | 0.00% | 0.00% |
| ND1-DdCBE_replicate1 | G | 0.00% | 0.00% | 0.00% | 0.00% | 0.00% | 0.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 0.01% | 0.02% | 0.01% | 0.00% | 99.47% | 0.01% | 0.00% | 0.00% |
| ND1-DdCBE_replicate2 | T | 99.97% | 0.22% | 0.03% | 99.96% | 0.03% | 99.98% | 99.99% | 99.99% |
| ND1-DdCBE_replicate2 | C | 0.02% | 99.75% | 99.96% | 0.04% | 0.49% | 0.01% | 0.01% | 0.01% |
| ND1-DdCBE_replicate2 | G | 0.00% | 0.00% | 0.00% | 0.00% | 0.01% | 0.00% | 0.00% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 0.00% | 0.01% | 0.01% | 0.00% | 99.46% | 0.00% | 0.00% | 0.00% |
| ND1-DdCBE_replicate3 | T | 99.98% | 0.15% | 0.02% | 99.95% | 0.01% | 99.98% | 99.98% | 99.98% |
| ND1-DdCBE_replicate3 | C | 0.02% | 99.83% | 99.97% | 0.05% | 0.53% | 0.02% | 0.01% | 0.01% |
| ND1-DdCBE_replicate3 | G | 0.00% | 0.00% | 0.00% | 0.00% | 0.00% | 0.00% | 0.00% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | G | C | C | T | A | G | C | C |
| ND1-DdCBE_replicate1 | A | 0.03% | 0.03% | 0.03% | 0.00% | 99.97% | 0.00% | 0.00% | 0.03% |
| ND1-DdCBE_replicate1 | T | 0.00% | 0.00% | 0.06% | 99.91% | 0.00% | 0.00% | 0.03% | 0.00% |
| ND1-DdCBE_replicate1 | C | 0.00% | 99.97% | 99.91% | 0.09% | 0.03% | 0.00% | 99.97% | 99.97% |
| ND1-DdCBE_replicate1 | G | 99.97% | 0.00% | 0.00% | 0.00% | 0.00% | 100.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 0.01% | 0.03% | 0.00% | 0.01% | 99.92% | 0.01% | 0.01% | 0.00% |
| ND1-DdCBE_replicate2 | T | 0.01% | 0.01% | 0.01% | 99.94% | 0.02% | 0.01% | 0.01% | 0.02% |
| ND1-DdCBE_replicate2 | C | 0.00% | 99.95% | 99.98% | 0.05% | 0.06% | 0.01% | 99.98% | 99.97% |

TABLE 12G-continued

| Base Percentages at TALE Binding Sites-ND1-DdCBE | | | | | | | | | |
|---|---|---|---|---|---|---|---|---|---|
| ND1-DdCBE_replicate2 | G | 99.98% | 0.00% | 0.00% | 0.00% | 0.01% | 99.97% | 0.00% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 0.01% | 0.03% | 0.00% | 0.00% | 99.89% | 0.01% | 0.01% | 0.00% |
| ND1-DdCBE_replicate3 | T | 0.00% | 0.00% | 0.00% | 99.95% | 0.01% | 0.01% | 0.01% | 0.01% |
| ND1-DdCBE_replicate3 | C | 0.00% | 99.96% | 100.00% | 0.05% | 0.08% | 0.00% | 99.98% | 99.99% |
| ND1-DdCBE_replicate3 | G | 99.99% | 0.00% | 0.00% | 0.00% | 0.01% | 99.98% | 0.00% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | G | A | T | C | A | G | G | G |
| ND1-DdCBE_replicate1 | A | 5.28% | 99.85% | 0.00% | 0.00% | 99.94% | 0.00% | 0.00% | 0.00% |
| ND1-DdCBE_replicate1 | T | 0.00% | 0.12% | 100.00% | 0.06% | 0.00% | 0.09% | 0.00% | 0.00% |
| ND1-DdCBE_replicate1 | C | 0.00% | 0.00% | 0.00% | 99.94% | 0.03% | 0.00% | 0.03% | 0.00% |
| ND1-DdCBE_replicate1 | G | 94.72% | 0.03% | 0.00% | 0.00% | 0.03% | 99.91% | 99.97% | 100.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 4.93% | 99.88% | 0.00% | 0.02% | 99.97% | 0.02% | 0.01% | 0.01% |
| ND1-DdCBE_replicate2 | T | 0.02% | 0.10% | 99.98% | 0.03% | 0.01% | 0.05% | 0.03% | 0.00% |
| ND1-DdCBE_replicate2 | C | 0.05% | 0.01% | 0.01% | 99.94% | 0.01% | 0.00% | 0.00% | 0.00% |
| ND1-DdCBE_replicate2 | G | 95.00% | 0.01% | 0.00% | 0.00% | 0.01% | 99.93% | 99.96% | 99.98% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 4.41% | 99.92% | 0.01% | 0.01% | 99.98% | 0.01% | 0.02% | 0.00% |
| ND1-DdCBE_replicate3 | T | 0.05% | 0.07% | 99.98% | 0.02% | 0.00% | 0.07% | 0.02% | 0.01% |
| ND1-DdCBE_replicate3 | C | 0.03% | 0.00% | 0.01% | 99.97% | 0.01% | 0.00% | 0.00% | 0.00% |
| ND1-DdCBE_replicate3 | G | 95.51% | 0.01% | 0.00% | 0.00% | 0.01% | 99.91% | 99.96% | 99.99% |

TABLE 12G-continued

| Base Percentages at TALE Binding Sites-ND1-DdCBE | | | | | | | | | |
|---|---|---|---|---|---|---|---|---|---|
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | A | C | T | A | C | G | C | C |
| ND1-DdCBE_replicate1 | A | 99.97% | 0.03% | 0.00% | 100.00% | 0.23% | 0.09% | 0.00% | 0.00% |
| ND1-DdCBE_replicate1 | T | 0.00% | 0.00% | 100.00% | 0.00% | 0.00% | 0.09% | 0.00% | 0.00% |
| ND1-DdCBE_replicate1 | C | 0.03% | 99.97% | 0.00% | 0.00% | 99.77% | 0.82% | 100.00% | 100.00% |
| ND1-DdCBE_replicate1 | G | 0.00% | 0.00% | 0.00% | 0.00% | 0.00% | 99.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 99.97% | 0.01% | 0.01% | 99.98% | 0.14% | 0.03% | 0.01% | 0.01% |
| ND1-DdCBE_replicate2 | T | 0.00% | 0.01% | 99.98% | 0.01% | 0.01% | 0.07% | 0.01% | 0.01% |
| ND1-DdCBE_replicate2 | C | 0.01% | 99.98% | 0.01% | 0.01% | 99.86% | 1.08% | 99.98% | 99.98% |
| ND1-DdCBE_replicate2 | G | 0.01% | 0.00% | 0.00% | 0.00% | 0.00% | 98.83% | 0.00% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 99.99% | 0.01% | 0.01% | 99.96% | 0.15% | 0.02% | 0.01% | 0.00% |
| ND1-DdCBE_replicate3 | T | 0.00% | 0.00% | 99.95% | 0.01% | 0.00% | 0.10% | 0.00% | 0.01% |
| ND1-DdCBE_replicate3 | C | 0.00% | 99.99% | 0.03% | 0.02% | 99.85% | 0.99% | 99.98% | 99.99% |
| ND1-DdCBE_replicate3 | G | 0.00% | 0.00% | 0.00% | 0.01% | 0.00% | 98.89% | 0.00% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | A | T | T | C | T | A | G | C |
| ND1-DdCBE_replicate1 | A | 99.85% | 0.00% | 0.00% | 0.00% | 0.00% | 99.88% | 0.03% | 0.06% |
| ND1-DdCBE_replicate1 | T | 0.06% | 99.97% | 100.00% | 0.06% | 99.97% | 0.06% | 0.06% | 0.03% |
| ND1-DdCBE_replicate1 | C | 0.09% | 0.03% | 0.00% | 99.94% | 0.03% | 0.00% | 0.00% | 99.91% |
| ND1-DdCBE_replicate1 | G | 0.00% | 0.00% | 0.00% | 0.00% | 0.00% | 0.06% | 99.91% | 0.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 99.84% | 0.00% | 0.00% | 0.01% | 0.00% | 99.89% | 0.01% | 0.02% |
| ND1-DdCBE_replicate2 | T | 0.06% | 99.98% | 99.99% | 0.03% | 99.97% | 0.06% | 0.01% | 0.04% |
| ND1-DdCBE_replicate2 | C | 0.08% | 0.02% | 0.01% | 99.95% | 0.02% | 0.04% | 0.00% | 99.94% |
| ND1-DdCBE_replicate2 | G | 0.01% | 0.00% | 0.00% | 0.00% | 0.00% | 0.00% | 99.97% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 99.88% | 0.00% | 0.00% | 0.00% | 0.00% | 99.91% | 0.02% | 0.00% |
| ND1-DdCBE_replicate3 | T | 0.02% | 99.98% | 99.99% | 0.03% | 99.99% | 0.04% | 0.01% | 0.02% |
| ND1-DdCBE_replicate3 | C | 0.10% | 0.01% | 0.01% | 99.96% | 0.01% | 0.05% | 0.01% | 99.97% |
| ND1-DdCBE_replicate3 | G | 0.00% | 0.01% | 0.00% | 0.00% | 0.00% | 0.00% | 99.96% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | G | T | T | T | A | C | T | C |
| ND1-DdCBE_replicate1 | A | 0.00% | 0.06% | 0.00% | 0.00% | 99.85% | 0.06% | 0.00% | 0.03% |
| ND1-DdCBE_replicate1 | T | 0.00% | 99.82% | 99.94% | 100.00% | 0.06% | 0.03% | 99.97% | 0.29% |
| ND1-DdCBE_replicate1 | C | 0.00% | 0.12% | 0.06% | 0.00% | 0.03% | 99.91% | 0.03% | 99.65% |
| ND1-DdCBE_replicate1 | G | 100.00% | 0.00% | 0.00% | 0.00% | 0.06% | 0.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.03% |
| ND1-DdCBE_replicate2 | A | 0.02% | 0.03% | 0.00% | 0.00% | 99.92% | 0.03% | 0.00% | 0.01% |
| ND1-DdCBE_replicate2 | T | 0.01% | 99.82% | 99.96% | 99.98% | 0.03% | 0.01% | 99.96% | 0.30% |
| ND1-DdCBE_replicate2 | C | 0.00% | 0.09% | 0.03% | 0.02% | 0.04% | 99.95% | 0.04% | 99.68% |
| ND1-DdCBE_replicate2 | G | 99.97% | 0.07% | 0.00% | 0.00% | 0.01% | 0.00% | 0.00% | 0.00% |
| ND1-DdCBE_replicate2 | N | 0.00% | 0.00% | 0.00% | 0.00% | 0.00% | 0.00% | 0.00% | 0.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate2 | — | 0.00% | 0.00% | 0.00% | 0.01% | 0.00% | 0.00% | 0.00% | 0.00% |
| ND1-DdCBE_replicate3 | A | 0.01% | 0.03% | 0.00% | 0.00% | 99.93% | 0.02% | 0.00% | 0.01% |
| ND1-DdCBE_replicate3 | T | 0.01% | 99.79% | 99.97% | 99.97% | 0.03% | 0.02% | 99.97% | 0.33% |
| ND1-DdCBE_replicate3 | C | 0.00% | 0.13% | 0.03% | 0.02% | 0.03% | 99.96% | 0.03% | 99.65% |
| ND1-DdCBE_replicate3 | G | 99.97% | 0.05% | 0.00% | 0.00% | 0.01% | 0.00% | 0.00% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | T | G | A | G | C | A | T | C |
| ND1-DdCBE_replicate1 | A | 0.15% | 0.00% | 99.97% | 0.00% | 0.00% | 99.97% | 0.00% | 0.03% |
| ND1-DdCBE_replicate1 | T | 98.74% | 0.00% | 0.00% | 0.00% | 0.00% | 0.00% | 100.00 | 0.00% |
| ND1-DdCBE_replicate1 | C | 1.03% | 0.00% | 0.00% | 0.03% | 100.00 | 0.00% | 0.00% | 99.97% |
| ND1-DdCBE_replicate1 | G | 0.09% | 100.00% | 0.03% | 99.97% | 0.00% | 0.03% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 0.11% | 0.02% | 99.91% | 0.01% | 0.01% | 99.92% | 0.02% | 0.00% |
| ND1-DdCBE_replicate2 | T | 98.81% | 0.02% | 0.02% | 0.01% | 0.03% | 0.04% | 99.96 | 0.02% |
| ND1-DdCBE_replicate2 | C | 0.96% | 0.00% | 0.01% | 0.00% | 99.96% | 0.03% | 0.02% | 99.98% |
| ND1-DdCBE_replicate2 | G | 0.12% | 99.96% | 0.06% | 99.99% | 0.01% | 0.01% | 0.00% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 0.10% | 0.02% | 99.93% | 0.01% | 0.00% | 99.92% | 0.01% | 0.02% |
| ND1-DdCBE_replicate3 | T | 98.81% | 0.00% | 0.02% | 0.00% | 0.03% | 0.03% | 99.97% | 0.02% |
| ND1-DdCBE_replicate3 | C | 0.95% | 0.00% | 0.02% | 0.00% | 99.96% | 0.04% | 0.02% | 99.96% |
| ND1-DdCBE_replicate3 | G | 0.14% | 99.98% | 0.04% | 99.99% | 0.01% | 0.01% | 0.00% | 0.00% |
| ND1-DdCBE_replicate3 | N | 0.00% | 0.00% | 0.00% | 0.00% | 0.00% | 0.00% | 0.00% | 0.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate3 | — | 0.00% | 0.00% | 0.00% | 0.00% | 0.00% | 0.00% | 0.00% | 0.00% |
| Batch | Nucleotide | C | T | G | A | T | C | G | G |
| ND1-DdCBE_replicate1 | A | 0.00% | 0.00% | 0.03% | 99.85% | 0.00% | 0.00% | 0.03% | 0.03% |
| ND1-DdCBE_replicate1 | T | 0.00% | 99.97% | 0.00% | 0.00% | 99.79% | 0.38% | 0.00% | 0.03% |
| ND1-DdCBE_replicate1 | C | 100.00% | 0.03% | 0.03% | 0.15% | 0.21% | 99.62% | 0.00% | 0.23% |
| ND1-DdCBE_replicate1 | G | 0.00% | 0.00% | 99.94% | 0.00% | 0.00% | 0.00% | 99.97% | 99.71% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 0.01% | 0.01% | 0.10% | 99.89% | 0.01% | 0.01% | 0.02% | 0.02% |
| ND1-DdCBE_replicate2 | T | 0.00% | 99.88% | 0.01% | 0.01% | 99.83% | 0.59% | 0.03% | 0.02% |
| ND1-DdCBE_replicate2 | C | 99.98% | 0.10% | 0.05% | 0.08% | 0.16% | 99.40% | 0.03% | 0.20% |
| ND1-DdCBE_replicate2 | G | 0.00% | 0.00% | 99.84% | 0.02% | 0.00% | 0.00% | 99.92% | 99.76% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 0.01% | 0.00% | 0.11% | 99.90% | 0.03% | 0.00% | 0.03% | 0.02% |
| ND1-DdCBE_replicate3 | T | 0.01% | 99.84% | 0.00% | 0.01% | 99.84% | 0.46% | 0.04% | 0.03% |
| ND1-DdCBE_replicate3 | C | 99.97% | 0.15% | 0.04% | 0.09% | 0.13% | 99.53% | 0.02% | 0.19% |
| ND1-DdCBE_replicate3 | G | 0.00% | 0.00% | 99.85% | 0.00% | 0.00% | 0.00% | 99.91% | 99.76% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.01% | 0.00% | 0.00% | 0.00% | 0.00% | 0.00% | 0.00% |
| Batch | Nucleotide | C | A | C | C | T | C | T | A |
| ND1-DdCBE_replicate1 | A | 0.03% | 99.88% | 0.00% | 0.00% | 0.00% | 0.00% | 0.00% | 99.88% |
| ND1-DdCBE_replicate1 | T | 0.00% | 0.00% | 0.00% | 0.00% | 99.97% | 0.03% | 99.97% | 0.09% |
| ND1-DdCBE_replicate1 | C | 99.97% | 0.09% | 100.00% | 100.00% | 0.03% | 99.97% | 0.03% | 0.00% |
| ND1-DdCBE_replicate1 | G | 0.00% | 0.03% | 0.00% | 0.00% | 0.00% | 0.00% | 0.00% | 0.03% |
| ND1-DdCBE_replicate1 | N | 0.00% | 0.00% | 0.00% | 0.00% | 0.00% | 0.00% | 0.00% | 0.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate1 | — | 0.00% | 0.00% | 0.00% | 0.00% | 0.00% | 0.00% | 0.00% | 0.00% |
| ND1-DdCBE_replicate2 | A | 0.01% | 99.94% | 0.01% | 0.01% | 0.01% | 0.01% | 0.00% | 99.86% |
| ND1-DdCBE_replicate2 | T | 0.03% | 0.01% | 0.01% | 0.01% | 99.98% | 0.05% | 99.98% | 0.04% |
| ND1-DdCBE_replicate2 | C | 99.96% | 0.04% | 99.99% | 99.98% | 0.01% | 99.94% | 0.02% | 0.09% |
| ND1-DdCBE_replicate2 | G | 0.00% | 0.01% | 0.00% | 0.00% | 0.00% | 0.00% | 0.00% | 0.01% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 0.00% | 99.90% | 0.00% | 0.01% | 0.01% | 0.00% | 0.01% | 99.81% |
| ND1-DdCBE_replicate3 | T | 0.04% | 0.02% | 0.01% | 0.00% | 99.98% | 0.03% | 99.97% | 0.04% |
| ND1-DdCBE_replicate3 | C | 99.96% | 0.08% | 99.98% | 99.99% | 0.01% | 99.96% | 0.02% | 0.13% |
| ND1-DdCBE_replicate3 | G | 0.00% | 0.00% | 0.00% | 0.00% | 0.00% | 0.00% | 0.00% | 0.02% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |
| Batch | Nucleotide | A | A | T | C | C | T | C | T |
| ND1-DdCBE_replicate1 | A | 99.82% | 99.79% | 0.00% | 0.03% | 0.00% | 0.00% | 0.00% | 0.03% |
| ND1-DdCBE_replicate1 | T | 0.03% | 0.00% | 100.00% | 47.25% | 46.54% | 100.00% | 31.24% | 99.91% |
| ND1-DdCBE_replicate1 | C | 0.09% | 0.21% | 0.00% | 52.73% | 53.46% | 0.00% | 68.76% | 0.06% |
| ND1-DdCBE_replicate1 | G | 0.06% | 0.00% | 0.00% | 0.00% | 0.00% | 0.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 99.85% | 99.83% | 0.01% | 0.01% | 0.01% | 0.00% | 0.00% | 0.01% |
| ND1-DdCBE_replicate2 | T | 0.05% | 0.02% | 99.98% | 47.68% | 46.95% | 99.99% | 29.89% | 99.97% |
| ND1-DdCBE_replicate2 | C | 0.08% | 0.15% | 0.01% | 52.31% | 53.04% | 0.01% | 70.11% | 0.02% |
| ND1-DdCBE_replicate2 | G | 0.02% | 0.00% | 0.00% | 0.00% | 0.00% | 0.00% | 0.00% | 0.00% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.01% | 0.00% | 0.00% | 0.00% |

TABLE 12G-continued

| Base Percentages at TALE Binding Sites-ND1-DdCBE | | | | | | | | | |
|---|---|---|---|---|---|---|---|---|---|
| ND1-DdCBE_replicate3 | A | 99.81% | 99.85% | 0.01% | 0.00% | 0.00% | 0.00% | 0.00% | 0.01% |
| ND1-DdCBE_replicate3 | T | 0.05% | 0.01% | 99.98% | 43.02% | 42.41% | 99.97% | 27.64% | 99.97% |
| ND1-DdCBE_replicate3 | C | 0.11% | 0.15% | 0.01% | 56.98% | 57.58% | 0.03% | 72.36% | 0.02% |
| ND1-DdCBE_replicate3 | G | 0.02% | 0.00% | 0.00% | 0.00% | 0.00% | 0.00% | 0.00% | 0.00% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.01% | 0.00% | 0.00% | 0.00% |
| Batch | Nucleotide | A | A | A | C | T | C | A | A |
| ND1-DdCBE_replicate1 | A | 99.97% | 100.00% | 99.97% | 0.15% | 0.00% | 0.12% | 99.97% | 100.00% |
| ND1-DdCBE_replicate1 | T | 0.00% | 0.00% | 0.00% | 0.00% | 99.97% | 0.00% | 0.00% | 0.00% |
| ND1-DdCBE_replicate1 | C | 0.03% | 0.00% | 0.03% | 99.85% | 0.03% | 99.88% | 0.03% | 0.00% |
| ND1-DdCBE_replicate1 | G | 0.00% | 0.00% | 0.00% | 0.00% | 0.00% | 0.00% | 0.00% | 0.00% |
| ND1-DdCBE_replicate1 | N | 0.00% | 0.00% | 0.00% | 0.00% | 0.00% | 0.00% | 0.00% | 0.00% |
| ND1-DdCBE_replicate1 | — | 0.00% | 0.00% | 0.00% | 0.00% | 0.00% | 0.00% | 0.00% | 0.00% |
| ND1-DdCBE_replicate2 | A | 99.95% | 99.97% | 99.97% | 0.03% | 0.01% | 0.06% | 99.97% | 99.95% |
| ND1-DdCBE_replicate2 | T | 0.01% | 0.00% | 0.01% | 0.01% | 99.96% | 0.02% | 0.01% | 0.01% |
| ND1-DdCBE_replicate2 | C | 0.03% | 0.02% | 0.02% | 99.95% | 0.03% | 99.92% | 0.02% | 0.03% |
| ND1-DdCBE_replicate2 | G | 0.01% | 0.01% | 0.00% | 0.00% | 0.00% | 0.00% | 0.01% | 0.01% |
| ND1-DdCBE_replicate2 | N | 0.00% | 0.00% | 0.00% | 0.00% | 0.00% | 0.00% | 0.00% | 0.00% |
| ND1-DdCBE_replicate2 | — | 0.00% | 0.00% | 0.00% | 0.00% | 0.00% | 0.00% | 0.00% | 0.00% |
| ND1-DdCBE_replicate3 | A | 99.93% | 99.96% | 99.97% | 0.08% | 0.00% | 0.06% | 99.97% | 99.96% |
| ND1-DdCBE_replicate3 | T | 0.00% | 0.00% | 0.01% | 0.00% | 99.97% | 0.01% | 0.01% | 0.01% |
| ND1-DdCBE_replicate3 | C | 0.05% | 0.03% | 0.01% | 99.92% | 0.02% | 99.93% | 0.01% | 0.03% |
| ND1-DdCBE_replicate3 | G | 0.02% | 0.01% | 0.01% | 0.00% | 0.00% | 0.00% | 0.01% | 0.01% |
| ND1-DdCBE_replicate3 | N | 0.00% | 0.00% | 0.00% | 0.00% | 0.00% | 0.00% | 0.00% | 0.00% |
| ND1-DdCBE_replicate3 | — | 0.00% | 0.00% | 0.00% | 0.00% | 0.00% | 0.00% | 0.00% | 0.00% |

TABLE 12G-continued

| Base Percentages at TALE Binding Sites-ND1-DdCBE | | | | |
|---|---|---|---|---|
| Batch | Nucleotide | C | G | C |
| ND1-DdCBE_replicate1 | A | 0.00% | 0.06% | 0.03% |
| ND1-DdCBE_replicate1 | T | 0.03% | 0.00% | 0.00% |
| ND1-DdCBE_replicate1 | C | 99.94% | 0.03% | 99.97% |
| ND1-DdCBE_replicate1 | G | 0.03% | 99.91% | 0.00% |
| ND1-DdCBE_replicate1 | N | 0.00% | 0.00% | 0.00% |
| ND1-DdCBE_replicate1 | — | 0.00% | 0.00% | 0.00% |
| ND1-DdCBE_replicate2 | A | 0.01% | 0.01% | 0.01% |
| ND1-DdCBE_replicate2 | T | 0.03% | 0.04% | 0.00% |
| ND1-DdCBE_replicate2 | C | 99.97% | 0.01% | 99.98% |
| ND1-DdCBE_replicate2 | G | 0.00% | 99.94% | 0.00% |
| ND1-DdCBE_replicate2 | N | 0.00% | 0.00% | 0.00% |
| ND1-DdCBE_replicate2 | — | 0.00% | 0.00% | 0.00% |
| ND1-DdCBE_replicate3 | A | 0.00% | 0.00% | 0.02% |
| ND1-DdCBE_replicate3 | T | 0.03% | 0.03% | 0.00% |
| ND1-DdCBE_replicate3 | C | 99.97% | 0.01% | 99.98% |
| ND1-DdCBE_replicate3 | G | 0.00% | 99.96% | 0.00% |
| ND1-DdCBE_replicate3 | N | 0.00% | 0.00% | 0.00% |
| ND1-DdCBE_replicate3 | — | 0.00% | 0.00% | 0.00% |

TABLE 12H

| Base Percentages at TALE Binding Sites-ATP8-DdCBE | | | | | | | | | |
|---|---|---|---|---|---|---|---|---|---|
| Batch | Nucleotide | C | C | T | C | A | T | C | A |
| ATP8-DdCBE_replicate 1 | A | 0.07% | 0.03% | 0.01% | 0.01% | 99.97% | 0.02% | 0.02% | 99.96% |
| ATP8-DdCBE_replicate 1 | T | 0.06% | 0.03% | 99.96% | 0.18% | 0.01% | 99.97% | 0.04% | 0.03% |
| ATP8-DdCBE_replicate1 | C | 99.86% | 99.93% | 0.03% | 99.81% | 0.01% | 0.02% | 99.93% | 0.01% |
| ATP8 DdCBE_replicate 1 | G | 0.01% | 0.00% | 0.00% | 0.00% | 0.01% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate1 | N | 0.00% | 0.00% | 0.00% | 0.00% | 0.00% | 0.00% | 0.00% | 0.00% |
| ATP8-DdCBE_replicate 1 | — | 0.00% | 0.00% | 0.00% | 0.00% | 0.00% | 0.00% | 0.00% | 0.00% |
| ATP8-DdCBE_replicate2 | A | 0.07% | 0.02% | 0.01% | 0.04% | 99.97% | 0.01% | 0.03% | 99.95% |
| ATP8-DdCBE_replicate2 | T | 0.06% | 0.02% | 99.96% | 0.23% | 0.01% | 99.99% | 0.07% | 0.02% |
| ATP8-DdCBE_replicate2 | C | 99.87% | 99.95% | 0.03% | 99.73% | 0.01% | 0.00% | 99.90% | 0.02% |
| ATP8-DdCBE_replicate2 | G | 0.01% | 0.00% | 0.00% | 0.00% | 0.01% | 0.00% | 0.00% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.01% | 0.00% | 0.00% | 0.00% | 0.00% | 0.00% | 0.00% |
| ATP8-DdCBE_replicate3 | A | 0.06% | 0.03% | 0.02% | 0.01% | 99.96% | 0.03% | 0.02% | 99.93% |
| ATP8-DdCBE_replicate3 | T | 0.04% | 0.02% | 99.96% | 0.18% | 0.01% | 99.97% | 0.07% | 0.03% |
| ATP8-DdCBE_replicate3 | C | 99.90% | 99.94% | 0.02% | 99.80% | 0.02% | 0.00% | 99.92% | 0.03% |
| ATP8-DdCBE_replicate3 | G | 0.01% | 0.00% | 0.00% | 0.00% | 0.01% | 0.00% | 0.00% | 0.01% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.00% | 0.01% | 0.00% | 0.00% | 0.00% | 0.01% |
| Batch | Nucleotide | A | A | A | C | A | C | A | A |
| ATP8-DdCBE_replicate 1 | A | 99.97% | 99.98% | 99.95% | 0.01% | 99.97% | 0.01% | 99.98% | 99.96% |
| ATP8-DdCBE_replicate1 | T | 0.01% | 0.01% | 0.01% | 0.05% | 0.01% | 0.03% | 0.00% | 0.02% |
| ATP8-DdCBE_replicate 1 | C | 0.01% | 0.00% | 0.01% | 99.94% | 0.00% | 99.96% | 0.01% | 0.01% |
| ATP8-DdCBE_replicate 1 | G | 0.01% | 0.01% | 0.01% | 0.00% | 0.02% | 0.00% | 0.01% | 0.01% |
| ATP8-DdCBE_replicate1 | N | 0.00% | 0.00% | 0.00% | 0.00% | 0.00% | 0.00% | 0.00% | 0.00% |
| ATP8-DdCBE_replicate 1 | — | 0.00% | 0.00% | 0.01% | 0.00% | 0.00% | 0.00% | 0.00% | 0.00% |
| ATP8-DdCBE_replicate2 | A | 99.95% | 99.96% | 99.95% | 0.02% | 99.97% | 0.03% | 99.97% | 99.95% |
| ATP8-DdCBE_replicate2 | T | 0.01% | 0.03% | 0.02% | 0.06% | 0.01% | 0.02% | 0.00% | 0.02% |
| ATP8-DdCBE_replicate2 | C | 0.02% | 0.00% | 0.01% | 99.91% | 0.00% | 99.95% | 0.01% | 0.02% |
| ATP8-DdCBE_replicate2 | G | 0.02% | 0.00% | 0.01% | 0.00% | 0.01% | 0.00% | 0.01% | 0.01% |
| ATP8-DdCBE_replicate2 | N | 0.00% | 0.00% | 0.00% | 0.00% | 0.00% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate2 | — | 0.00% | 0.00% | 0.01% | 0.00% | 0.00% | 0.00% | 0.00% | 0.00% |
| ATP8-DdCBE_replicate3 | A | 99.95% | 99.96% | 99.95% | 0.02% | 99.96% | 0.01% | 99.98% | 99.93% |
| ATP8-DdCBE_replicate3 | T | 0.02% | 0.02% | 0.02% | 0.04% | 0.02% | 0.02% | 0.00% | 0.02% |
| ATP8-DdCBE_replicate3 | C | 0.01% | 0.01% | 0.01% | 99.94% | 0.01% | 99.96% | 0.01% | 0.03% |
| ATP8-DdCBE_replicate3 | G | 0.02% | 0.02% | 0.00% | 0.00% | 0.01% | 0.00% | 0.01% | 0.01% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.01% | 0.00% | 0.00% | 0.00% | 0.00% | 0.00% |
| Batch | Nucleotide | C | T | C | A | C | C | A | A |
| ATP8-DdCBE_replicate 1 | A | 0.04% | 0.03% | 0.05% | 99.98% | 0.02% | 0.02% | 99.97% | 99.98% |
| ATP8-DdCBE_replicate 1 | T | 0.02% | 99.95% | 0.07% | 0.01% | 0.01% | 0.01% | 0.01% | 0.01% |
| ATP8-DdCBE_replicate 1 | C | 99.94% | 0.02% | 99.87% | 0.00% | 99.97% | 99.96% | 0.01% | 0.00% |
| ATP8-DdCBE_replicate1 | G | 0.00% | 0.00% | 0.00% | 0.01% | 0.00% | 0.01% | 0.01% | 0.01% |
| ATP8-DdCBE_replicate1 | N | 0.00% | 0.00% | 0.00% | 0.00% | 0.00% | 0.00% | 0.00% | 0.00% |
| ATP8-DdCBE_replicate1 | — | 0.00% | 0.00% | 0.00% | 0.00% | 0.00% | 0.00% | 0.00% | 0.00% |
| ATP8-DdCBE_replicate2 | A | 0.01% | 0.01% | 0.05% | 99.97% | 0.01% | 0.03% | 99.97% | 99.96% |
| ATP8-DdCBE_replicate2 | T | 0.01% | 99.97% | 0.07% | 0.01% | 0.02% | 0.02% | 0.01% | 0.03% |
| ATP8-DdCBE_replicate2 | C | 99.97% | 0.02% | 99.87% | 0.01% | 99.97% | 99.95% | 0.01% | 0.00% |
| ATP8-DdCBE_replicate2 | G | 0.00% | 0.00% | 0.00% | 0.00% | 0.00% | 0.00% | 0.00% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.01% | 0.00% | 0.00% | 0.00% | 0.00% | 0.00% | 0.00% | 0.00% |
| ATP8-DdCBE_replicate3 | A | 0.02% | 0.02% | 0.04% | 99.96% | 0.02% | 0.02% | 99.98% | 99.96% |
| ATP8-DdCBE_replicate3 | T | 0.02% | 99.96% | 0.04% | 0.01% | 0.01% | 0.02% | 0.01% | 0.02% |
| ATP8-DdCBE_replicate3 | C | 99.94% | 0.01% | 99.92% | 0.01% | 99.97% | 99.96% | 0.01% | 0.01% |
| ATP8-DdCBE_replicate3 | G | 0.00% | 0.00% | 0.00% | 0.02% | 0.00% | 0.00% | 0.01% | 0.01% |
| ATP8-DdCBE_replicate3 | N | 0.00% | 0.00% | 0.00% | 0.00% | 0.00% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate3 | — | 0.02% | 0.00% | 0.00% | 0.01% | 0.00% | 0.00% | 0.00% | 0.00% |
| Batch | Nucleotide | A | A | A | T | T | A | T | A |
| ATP8-DdCBE_replicate1 | A | 99.99% | 99.97% | 99.93% | 0.01% | 0.14% | 99.98% | 0.04% | 99.98% |
| ATP8-DdCBE_replicate 1 | T | 0.00% | 0.02% | 0.02% | 99.95% | 99.84% | 0.01% | 99.94% | 0.01% |
| ATP8-DdCBE_replicate 1 | C | 0.00% | 0.00% | 0.00% | 0.03% | 0.01% | 0.00% | 0.01% | 0.00% |
| ATP8-DdCBE_replicate 1 | G | 0.01% | 0.01% | 0.00% | 0.00% | 0.01% | 0.00% | 0.00% | 0.01% |
| ATP8-DdCBE_replicate 1 | N | 0.00% | 0.00% | 0.00% | 0.00% | 0.00% | 0.00% | 0.00% | 0.00% |
| ATP8-DdCBE_replicate1 | — | 0.00% | 0.00% | 0.05% | 0.00% | 0.01% | 0.00% | 0.01% | 0.00% |
| ATP8-DdCBE_replicate2 | A | 99.99% | 99.97% | 99.94% | 0.02% | 0.16% | 99.97% | 0.04% | 99.96% |
| ATP8-DdCBE_replicate2 | T | 0.00% | 0.01% | 0.02% | 99.93% | 99.83% | 0.01% | 99.94% | 0.03% |
| ATP8-DdCBE_replicate2 | C | 0.00% | 0.01% | 0.00% | 0.05% | 0.00% | 0.00% | 0.01% | 0.00% |
| ATP8-DdCBE_replicate2 | G | 0.01% | 0.01% | 0.01% | 0.00% | 0.00% | 0.01% | 0.00% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.03% | 0.00% | 0.00% | 0.00% | 0.00% | 0.00% |
| ATP8-DdCBE_replicate3 | A | 99.98% | 99.98% | 99.93% | 0.01% | 0.13% | 99.97% | 0.02% | 99.98% |
| ATP8-DdCBE_replicate3 | T | 0.00% | 0.01% | 0.03% | 99.94% | 99.85% | 0.02% | 99.96% | 0.01% |
| ATP8-DdCBE_replicate3 | C | 0.01% | 0.00% | 0.00% | 0.04% | 0.02% | 0.00% | 0.01% | 0.01% |
| ATP8-DdCBE_replicate3 | G | 0.01% | 0.00% | 0.00% | 0.00% | 0.00% | 0.01% | 0.00% | 0.01% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.04% | 0.00% | 0.00% | 0.00% | 0.00% | 0.00% |
| Batch | Nucleotide | C | C | C | A | A | C | T | A |
| ATP8-DdCBE_replicate 1 | A | 0.01% | 0.01% | 0.03% | 99.98% | 99.25% | 0.01% | 0.02% | 99.97% |
| ATP8-DdCBE_replicate 1 | T | 0.01% | 0.01% | 0.02% | 0.01% | 0.01% | 0.01% | 99.97% | 0.02% |
| ATP8-DdCBE_replicate1 | C | 99.97% | 99.97% | 99.93% | 0.01% | 0.72% | 99.97% | 0.01% | 0.00% |
| ATP8 DdCBE_replicate 1 | G | 0.00% | 0.00% | 0.00% | 0.00% | 0.02% | 0.00% | 0.00% | 0.01% |
| ATP8-DdCBE_replicate1 | N | 0.00% | 0.00% | 0.00% | 0.00% | 0.00% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate 1 | — | 0.00% | 0.00% | 0.01% | 0.00% | 0.00% | 0.00% | 0.00% | 0.00% |
| ATP8-DdCBE_replicate2 | A | 0.02% | 0.01% | 0.02% | 99.97% | 99.30% | 0.03% | 0.01% | 99.96% |
| ATP8-DdCBE_replicate2 | T | 0.03% | 0.03% | 0.02% | 0.01% | 0.02% | 0.00% | 99.97% | 0.02% |
| ATP8-DdCBE_replicate2 | C | 99.95% | 99.96% | 99.95% | 0.01% | 0.64% | 99.97% | 0.01% | 0.01% |
| ATP8-DdCBE_replicate2 | G | 0.00% | 0.00% | 0.00% | 0.01% | 0.03% | 0.00% | 0.00% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.00% | 0.00% | 0.00% | 0.00% | 0.00% | 0.00% |
| ATP8-DdCBE_replicate3 | A | 0.03% | 0.02% | 0.03% | 99.98% | 99.25% | 0.01% | 0.02% | 99.97% |
| ATP8-DdCBE_replicate3 | T | 0.00% | 0.02% | 0.03% | 0.00% | 0.02% | 0.02% | 99.97% | 0.01% |
| ATP8-DdCBE_replicate3 | C | 99.96% | 99.95% | 99.94% | 0.01% | 0.72% | 99.95% | 0.01% | 0.02% |
| ATP8-DdCBE_replicate3 | G | 0.00% | 0.00% | 0.00% | 0.01% | 0.02% | 0.00% | 0.00% | 0.01% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.01% | 0.01% | 0.01% | 0.00% | 0.00% | 0.01% | 0.01% | 0.00% |
| Batch | Nucleotide | A | C | T | A | C | C | A | C |
| ATP8-DdCBE_replicate 1 | A | 99.97% | 0.02% | 0.03% | 99.96% | 0.02% | 0.15% | 99.96% | 0.01% |
| ATP8-DdCBE_replicate1 | T | 0.01% | 0.04% | 99.95% | 0.01% | 0.03% | 0.04% | 0.01% | 0.02% |
| ATP8-DdCBE_replicate 1 | C | 0.01% | 99.94% | 0.02% | 0.02% | 99.95% | 99.80% | 0.00% | 99.97% |
| ATP8-DdCBE_replicate 1 | G | 0.00% | 0.00% | 0.00% | 0.01% | 0.00% | 0.00% | 0.01% | 0.00% |
| ATP8-DdCBE_replicate1 | N | 0.00% | 0.00% | 0.00% | 0.00% | 0.00% | 0.00% | 0.00% | 0.00% |
| ATP8-DdCBE_replicate 1 | — | 0.00% | 0.00% | 0.00% | 0.00% | 0.00% | 0.00% | 0.00% | 0.00% |
| ATP8-DdCBE_replicate2 | A | 99.97% | 0.02% | 0.01% | 99.96% | 0.03% | 0.13% | 99.96% | 0.02% |
| ATP8-DdCBE_replicate2 | T | 0.01% | 0.04% | 99.96% | 0.01% | 0.01% | 0.06% | 0.02% | 0.02% |
| ATP8-DdCBE_replicate2 | C | 0.01% | 99.93% | 0.02% | 0.01% | 99.96% | 99.81% | 0.01% | 99.96% |
| ATP8-DdCBE_replicate2 | G | 0.01% | 0.00% | 0.00% | 0.01% | 0.00% | 0.00% | 0.00% | 0.00% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.00% | 0.00% | 0.00% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate3 | A | 99.97% | 0.02% | 0.02% | 99.96% | 0.03% | 0.15% | 99.96% | 0.02% |
| ATP8-DdCBE_replicate3 | T | 0.01% | 0.04% | 99.95% | 0.02% | 0.04% | 0.06% | 0.02% | 0.02% |
| ATP8-DdCBE_replicate3 | C | 0.01% | 99.93% | 0.03% | 0.02% | 99.93% | 99.78% | 0.01% | 99.96% |
| ATP8-DdCBE_replicate3 | G | 0.01% | 0.00% | 0.00% | 0.00% | 0.00% | 0.00% | 0.01% | 0.00% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.00% | 0.00% | 0.00% | 0.01% | 0.01% | 0.00% |
| Batch | Nucleotide | A | G | C | C | C | A | T | A |
| ATP8-DdCBE_replicate 1 | A | 99.97% | 0.06% | 0.02% | 0.02% | 0.06% | 99.95% | 0.02% | 99.98% |
| ATP8-DdCBE_replicate 1 | T | 0.01% | 0.04% | 0.01% | 0.02% | 0.03% | 0.03% | 99.97% | 0.01% |
| ATP8-DdCBE_replicate 1 | C | 0.01% | 0.06% | 99.97% | 99.95% | 99.91% | 0.01% | 0.01% | 0.00% |
| ATP8-DdCBE_replicate1 | G | 0.01% | 99.83% | 0.00% | 0.00% | 0.00% | 0.02% | 0.00% | 0.01% |
| ATP8-DdCBE_replicate1 | N | 0.00% | 0.00% | 0.00% | 0.00% | 0.00% | 0.00% | 0.00% | 0.00% |
| ATP8-DdCBE_replicate1 | — | 0.00% | 0.01% | 0.00% | 0.00% | 0.00% | 0.00% | 0.00% | 0.00% |
| ATP8-DdCBE_replicate2 | A | 99.98% | 0.02% | 0.01% | 0.04% | 0.06% | 99.96% | 0.01% | 99.97% |
| ATP8-DdCBE_replicate2 | T | 0.00% | 0.03% | 0.01% | 0.03% | 0.04% | 0.03% | 99.98% | 0.01% |
| ATP8-DdCBE_replicate2 | C | 0.00% | 0.07% | 99.97% | 99.93% | 99.90% | 0.01% | 0.01% | 0.00% |
| ATP8-DdCBE_replicate2 | G | 0.01% | 99.88% | 0.00% | 0.00% | 0.00% | 0.01% | 0.00% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.01% | 0.00% | 0.00% | 0.00% | 0.00% | 0.00% | 0.00% | 0.00% |
| ATP8-DdCBE_replicate3 | A | 99.96% | 0.06% | 0.02% | 0.02% | 0.05% | 99.96% | 0.01% | 99.99% |
| ATP8-DdCBE_replicate3 | T | 0.00% | 0.04% | 0.02% | 0.02% | 0.03% | 0.03% | 99.97% | 0.01% |
| ATP8-DdCBE_replicate3 | C | 0.01% | 0.05% | 99.96% | 99.96% | 99.91% | 0.01% | 0.02% | 0.00% |
| ATP8-DdCBE_replicate3 | G | 0.02% | 99.85% | 0.00% | 0.00% | 0.00% | 0.01% | 0.00% | 0.01% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.01% | 0.00% | 0.00% | 0.00% | 0.01% | 0.00% | 0.01% | 0.00% |

TABLE 12H-continued

| Base Percentages at TALE Binding Sites-ATP8-DdCBE | | | | | |
|---|---|---|---|---|---|
| Batch | Nucleotide | A | C | A | A |
| ATP8-DdCBE_replicate1 | A | 99.97% | 0.07% | 99.98% | 99.99% |
| ATP8-DdCBE_replicate 1 | T | 0.01% | 0.02% | 0.00% | 0.00% |
| ATP8-DdCBE_replicate 1 | C | 0.01% | 99.91% | 0.00% | 0.00% |
| ATP8-DdCBE_replicate 1 | G | 0.01% | 0.00% | 0.01% | 0.01% |
| ATP8-DdCBE_replicate 1 | N | 0.00% | 0.00% | 0.00% | 0.00% |
| ATP8-DdCBE_replicate1 | — | 0.00% | 0.00% | 0.00% | 0.00% |
| ATP8-DdCBE_replicate2 | A | 99.94% | 0.08% | 99.99% | 99.99% |
| ATP8-DdCBE_replicate2 | T | 0.02% | 0.01% | 0.00% | 0.01% |
| ATP8-DdCBE_replicate2 | C | 0.03% | 99.91% | 0.00% | 0.00% |
| ATP8-DdCBE_replicate2 | G | 0.01% | 0.00% | 0.00% | 0.00% |
| ATP8-DdCBE_replicate2 | N | 0.00% | 0.00% | 0.00% | 0.00% |
| ATP8-DdCBE_replicate2 | — | 0.01% | 0.00% | 0.00% | 0.00% |
| ATP8-DdCBE_replicate3 | A | 99.94% | 0.05% | 99.98% | 99.97% |
| ATP8-DdCBE_replicate3 | T | 0.02% | 0.01% | 0.00% | 0.02% |
| ATP8-DdCBE_replicate3 | C | 0.02% | 99.94% | 0.00% | 0.01% |
| ATP8-DdCBE_replicate3 | G | 0.01% | 0.00% | 0.01% | 0.01% |
| ATP8-DdCBE_replicate3 | N | 0.00% | 0.00% | 0.00% | 0.00% |
| ATP8-DdCBE_replicate3 | — | 0.01% | 0.00% | 0.00% | 0.00% |

| Batch | Nucleotide | A | A | A | A | T | A | T | T |
|---|---|---|---|---|---|---|---|---|---|
| ATP8-DdCBE_replicate 1 | A | 99.98% | 99.97% | 99.97% | 99.94% | 0.01% | 99.97% | 0.01% | 0.03% |
| ATP8-DdCBE_replicate 1 | T | 0.01% | 0.02% | 0.01% | 0.01% | 99.99% | 0.01% | 99.98% | 99.95% |
| ATP8-DdCBE_replicate1 | C | 0.00% | 0.00% | 0.01% | 0.01% | 0.01% | 0.02% | 0.01% | 0.02% |
| ATP8 DdCBE_replicate 1 | G | 0.01% | 0.01% | 0.01% | 0.01% | 0.00% | 0.00% | 0.00% | 0.00% |
| ATP8-DdCBE_replicate1 | N | 0.00% | 0.00% | 0.00% | 0.00% | 0.00% | 0.00% | 0.00% | 0.00% |
| ATP8-DdCBE_replicate 1 | — | 0.00% | 0.00% | 0.00% | 0.03% | 0.00% | 0.00% | 0.00% | 0.00% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate2 | A | 99.97% | 99.96% | 99.97% | 99.92% | 0.00% | 99.95% | 0.02% | 0.01% |
| ATP8-DdCBE_replicate2 | T | 0.01% | 0.03% | 0.02% | 0.01% | 99.99% | 0.02% | 99.97% | 99.97% |
| ATP8-DdCBE_replicate2 | C | 0.01% | 0.00% | 0.01% | 0.02% | 0.00% | 0.02% | 0.01% | 0.01% |
| ATP8-DdCBE_replicate2 | G | 0.01% | 0.01% | 0.00% | 0.01% | 0.00% | 0.01% | 0.00% | 0.00% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.00% | 0.03% | 0.00% | 0.00% | 0.00% | 0.00% |
| ATP8-DdCBE_replicate3 | A | 99.98% | 99.97% | 99.96% | 99.95% | 0.00% | 99.97% | 0.02% | 0.02% |
| ATP8-DdCBE_replicate3 | T | 0.01% | 0.01% | 0.01% | 0.00% | 99.99% | 0.00% | 99.96% | 99.95% |
| ATP8-DdCBE_replicate3 | C | 0.00% | 0.01% | 0.01% | 0.02% | 0.00% | 0.02% | 0.02% | 0.02% |
| ATP8-DdCBE_replicate3 | G | 0.01% | 0.01% | 0.01% | 0.01% | 0.00% | 0.01% | 0.01% | 0.00% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.00% | 0.03% | 0.00% | 0.00% | 0.00% | 0.00% |
| Batch | Nucleotide | C | T | A | C | C | T | C | C |
| ATP8-DdCBE_replicate 1 | A | 0.01% | 0.03% | 99.95% | 0.02% | 0.02% | 0.01% | 0.01% | 0.01% |
| ATP8-DdCBE_replicate1 | T | 0.03% | 99.96% | 0.03% | 0.04% | 0.02% | 99.97% | 9.61% | 4.46% |
| ATP8-DdCBE_replicate 1 | C | 99.96% | 0.01% | 0.02% | 99.94% | 99.96% | 0.02% | 90.37% | 95.53% |
| ATP8-DdCBE_replicate 1 | G | 0.00% | 0.00% | 0.00% | 0.00% | 0.00% | 0.00% | 0.00% | 0.00% |
| ATP8-DdCBE_replicate1 | N | 0.00% | 0.00% | 0.00% | 0.00% | 0.00% | 0.00% | 0.00% | 0.00% |
| ATP8-DdCBE_replicate 1 | — | 0.00% | 0.00% | 0.00% | 0.00% | 0.00% | 0.00% | 0.00% | 0.00% |
| ATP8-DdCBE_replicate2 | A | 0.03% | 0.02% | 99.93% | 0.01% | 0.03% | 0.02% | 0.03% | 0.01% |
| ATP8-DdCBE_replicate2 | T | 0.02% | 99.95% | 0.03% | 0.02% | 0.02% | 99.97% | 12.09% | 5.71% |
| ATP8-DdCBE_replicate2 | C | 99.95% | 0.03% | 0.02% | 99.97% | 99.94% | 0.01% | 87.88% | 94.27% |
| ATP8-DdCBE_replicate2 | G | 0.00% | 0.00% | 0.02% | 0.00% | 0.00% | 0.00% | 0.00% | 0.00% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.00% | 0.00% | 0.00% | 0.00% | 0.00% | 0.00% |
| ATP8-DdCBE_replicate3 | A | 0.04% | 0.02% | 99.94% | 0.03% | 0.03% | 0.03% | 0.02% | 0.01% |

TABLE 12H-continued

| Base Percentages at TALE Binding Sites-ATP8-DdCBE | | | | | | | | | |
|---|---|---|---|---|---|---|---|---|---|
| ATP8-DdCBE_replicate3 | T | 0.02% | 99.96% | 0.03% | 0.01% | 0.03% | 99.95% | 10.85% | 5.12% |
| ATP8-DdCBE_replicate3 | C | 99.94% | 0.02% | 0.02% | 99.95% | 99.93% | 0.02% | 89.13% | 94.86% |
| ATP8-DdCBE_replicate3 | G | 0.00% | 0.00% | 0.00% | 0.00% | 0.00% | 0.00% | 0.00% | 0.00% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.00% | 0.00% | 0.00% | 0.00% | 0.00% | 0.00% |
| Batch | Nucleotide | A | A | A | A | T | A | A | A |
| ATP8-DdCBE_replicate 1 | A | 99.97% | 99.96% | 99.98% | 99.93% | 0.02% | 99.96% | 99.97% | 99.99% |
| ATP8-DdCBE_replicate 1 | T | 0.01% | 0.01% | 0.00% | 0.03% | 99.97% | 0.01% | 0.02% | 0.00% |
| ATP8-DdCBE_replicate 1 | C | 0.00% | 0.01% | 0.00% | 0.02% | 0.01% | 0.01% | 0.00% | 0.00% |
| ATP8-DdCBE_replicate1 | G | 0.01% | 0.02% | 0.01% | 0.00% | 0.00% | 0.01% | 0.01% | 0.01% |
| ATP8-DdCBE_replicate1 | N | 0.00% | 0.00% | 0.00% | 0.00% | 0.00% | 0.00% | 0.00% | 0.00% |
| ATP8-DdCBE_replicate1 | — | 0.00% | 0.00% | 0.00% | 0.01% | 0.00% | 0.00% | 0.00% | 0.00% |
| ATP8-DdCBE_replicate2 | A | 99.97% | 99.97% | 99.98% | 99.90% | 0.02% | 99.97% | 99.97% | 99.99% |
| ATP8-DdCBE_replicate2 | T | 0.02% | 0.01% | 0.01% | 0.04% | 99.96% | 0.01% | 0.02% | 0.01% |
| ATP8-DdCBE_replicate2 | C | 0.00% | 0.00% | 0.00% | 0.01% | 0.01% | 0.01% | 0.00% | 0.00% |
| ATP8-DdCBE_replicate2 | G | 0.00% | 0.01% | 0.00% | 0.02% | 0.00% | 0.01% | 0.01% | 0.01% |
| ATP8-DdCBE_replicate2 | N | 0.00% | 0.00% | 0.00% | 0.00% | 0.00% | 0.00% | 0.00% | 0.00% |
| ATP8-DdCBE_replicate2 | — | 0.00% | 0.00% | 0.00% | 0.03% | 0.00% | 0.00% | 0.00% | 0.00% |
| ATP8-DdCBE_replicate3 | A | 99.97% | 99.97% | 99.97% | 99.91% | 0.01% | 99.97% | 99.98% | 99.99% |
| ATP8-DdCBE_replicate3 | T | 0.01% | 0.02% | 0.01% | 0.04% | 99.96% | 0.01% | 0.01% | 0.01% |
| ATP8-DdCBE_replicate3 | C | 0.01% | 0.00% | 0.01% | 0.02% | 0.02% | 0.01% | 0.00% | 0.00% |
| ATP8-DdCBE_replicate3 | G | 0.01% | 0.01% | 0.01% | 0.00% | 0.00% | 0.01% | 0.00% | 0.00% |
| ATP8-DdCBE_replicate3 | N | 0.00% | 0.00% | 0.00% | 0.00% | 0.00% | 0.00% | 0.00% | 0.00% |
| ATP8-DdCBE_replicate3 | — | 0.00% | 0.00% | 0.00% | 0.03% | 0.01% | 0.00% | 0.00% | 0.00% |

Supplementary Sequences

Sequences used for $DddA_{tox}$ characterization in bacteria.

| | | SEQ ID NOs |
|---|---|---|
| Primers for cloning dddA deaminase domain into pScrhaB2-V | | |
| NdeI-DddA | TCAAGTACTACATATGATAGGACTCAACGGTGGGGC | 160 |
| DddA-NS-XbaI | TACTGATTGATCTAGAACAACCTCCTTTCGTGGGGA | 161 |
| Primers for cloning dddA deaminase domain into pPSV39-CV | | |
| DddAI-XbaI | TACTGATTGATCTAGATTACAACTCGCTCCATGTCAGTTG | 162 |
| SacI-RBS-DddAI | TCAAGTACTAGAGCTCACGGGAGGAAAGATGTACGCAGACG ATTTCGACG | 163 |
| Primers for cloning dddA deaminase domain into pETDuet-1 mcs1 | | |
| BamHI-DddA_duet | TATCAGAAACGGATCCATAGGACTCAACGGTGGGGC | 164 |
| DddA_duet-NotI | TATGTTACTAGCGGCCGCTCAACAACCTCCTTTCGTGGG | 165 |
| Primers for cloning dddA deaminase domain into pETDuet-1 mcs1 | | |
| NdeI_DddAI | TCAAGTACTACATATGTACGCAGACGATTTCGACG | 166 |
| DddAI-BglII | TATGTTACTAAGATCTTTACAACTCGCTCCATGTCAGTTG | 167 |
| Primers for cloning dddA(E1347A) deaminase domain into pETDuet-1 mcs1 | | |
| DddA_E1347A-3 | CGGACTGACCGGCAACGTGCCCGGCGTTTGC | 168 |
| DddA_E1347A-4 | GGCACGTTGCCGGTCAGTCCGCCTTATTTATGC | 169 |
| Primers for construction of deletion cassette for icmF1 using pDONRPEX18Gm-SceI-pheS | | |
| HindIII-ISecI-IcmF1 | TGTTAAGCTAAAGCTTTAGGGATAACAGGGTAATCTGCTGG ATCCGGATTTCCG | 170 |
| IcmF1-2 | TTCAGCATGCTTGCGGCTCGAGTTGATGCGTTGCATAGGAC GTTCA | 171 |
| Icmf1-3 | AACTCGAGCCGCAAGCATGCTGAAAGGGCGCAATGACGCAA ACC | 172 |
| Bcen_IcmF1-XbaI | TCAATCAGTATCTAGAGTAGAACGGATCGACCGGCA | 173 |
| HindIII-ISecI-IcmF2 | TGTTAAGCTAAAGCTTTAGGGATAACAGGGTAATCGCTCAT TGTCCGTTTGCAGC | 174 |
| IcmF2-2 | TTCAGCATGCTTGCGGCTCGAGTTGCGAACGATCATGTGTG ATACAC | 175 |
| IcmF2-3 | AACTCGAGCCGCAAGCATGCTGAATTTCGAGACCCGCGATG ACG | 176 |
| IcmF2-XbaI | TCAATCAGTATCTAGACGAGCCGCTCGATACGATTG | 177 |
| Primers for construction of deletion cassette for dddA-dddAr using pDONRPEX18Gm-Scel-pheS | | |
| HindIII-ISecI-DddADddAI | TGTTAAGCTAAAGCTTTAGGGATAACAGGGTAATGTGGTAC TTCAACGAAGCAGATG | 178 |
| DddADddAI-2 | TTCAGCATGCTTGCGGCTCGAGTTATCGGATCAGTGACTCG TGC | 179 |
| DddADddAI-3 | AACTCGAGCCGCAAGCATGCTGAAAGCGAGTTGTAAGAAAC GGAGC | 180 |

-continued

| | | |
|---|---|---|
| Bcen_E1-I1-XbaI | TCAATCAGTATCTAGAAGTGAGCTCTCCGAAATCGAAC | 181 |
| Primers for construction of dddA(E147A) using pDONRPEX18Gm-SceI-pheS | | |
| Bcen_E1347A-1 | TAAAACGACGGCCAGTGCCAAGCTTAGGGATAACAGGGTAATAGCAGCTACGTGTACAGTCCGGACGCACCGTATTCGC | 182 |
| Bcen_E1347A-2 | AATAAGGCGGACTGACCGGCAACGTGCCCGGCGTTTGCGTAGTTGG | 183 |
| Bcen_E1347A-3 | CCGGGCACGTTGCCGGTCAGTCCGCCTTATTTATGCGC | 184 |
| Bcen_E1347A-4 | GCTCGGTACCCGGGGATCCTCTAGACTCGCTCCATGTCAGTTGCTCGGGCCG | 185 |
| Primers for cloning of cdd into pScrhaB2-V | | |
| CDD_fwd | TGAAATTCAGCAGGATCACATATGCATCCACGTTTTCAAACCGC | 186 |
| CDD_rev | TGCATGCCTGCAGGTCGACTCTAGAAGCGAGAAGCACTCGGTC | 187 |
| Primers for cloning of tadA into pScrhaB2-V | | |
| tadA fwd | AATGATACGGCGACCACCGAGATCTACACTCTTTCCCTACACGACGCTCTTCCGATCT | 188 |
| tadA_rev | TGCATGCCTGCAGGTCGACTCTAGACTTAAAAATACGTATCGCTTTAG | 189 |
| Primers for cloning of A3G into pScrhaB2-V | | |
| A3G_fwd | TGAAATTCAGCAGGATCACATATGGACCCACCAACTTTTACTTTTAATTTTAAC | 190 |
| A3G_rev | TGCCTGCAGGTCGACTCTAGAGTTTTCCTGGTTTTGTAAGATTG | 191 |
| Primers for ung deletion in *E.coli* | | |
| ung_del-F | TAGAAAGAAGCAGTTAAGCTAGGCGGATTGAAGATTCGCAGGAGAGCGAGATGGTGTAGGCTGGAGCTGCTTC | 192 |
| ung_del-R | TGATAAATCAGCCGGGGGCAACTCTGCCATCCGGCATTTCCCCGCAAATTTACATATGAATATCCTCCTTAG | 193 |
| Primers for cloning ung into pBAD24 | | |
| EcoRI_ung | TAGTACAGAGAATTCATGGCTAACGAATTAACCTGGCATGAC | 194 |
| ung_XbaI | TCAATCAGTATCTAGATTACTCACTCTCTGCCGGTAATACTG | 195 |
| Sequences for in vitro deamination assays | | |
| S36-CTCGCC | AAAAAAAAAAAAAAACTCGCCAAAAAAAAAAAAAAA | 196 |
| S35-GA**C**GG | AAAAAAAAAAAAAAAGA**C**GGAAAAAAAAAAAAAAA | 197 |
| S35-GT**C**GG | AAAAAAAAAAAAAAAGT**C**GGAAAAAAAAAAAAAAA | 198 |
| S35-GG**C**GG | AAAAAAAAAAAAAAAGG**C**GGAAAAAAAAAAAAAAA | 199 |
| S35-GC**C**GG | AAAAAAAAAAAAAAAGC**C**GGAAAAAAAAAAAAAAA | 200 |

Sequences used for characterization of $DddA_{tox}$ and its fusions in mammalian cells.

| | | SEQ ID NOs |
|---|---|---|
| Primers used for generating sgRNA transfection plasmids. Rev_sgRNA_plasmid was used in all cases | | |
| rev_sgRNA_ plasmid | GGTGTTTCGTCCTTTCCACAAG | 201 |
| fwd_saG1 | GTCTGTGCCCCTCCCTCCCTGGCGTTTTAGTACTCTGT AATGAAAATTACAGAATCTAC | 202 |
| fwd_saG2 | GCCCCTCCCTCCCTGGCCCAGGTGTTTTAGTACTCTGT AATGAAAATTACAGAATCTAC | 203 |
| fwd_saG3 | GCCCTCCCTGGCCCAGGTGAAGGGTTTTAGTACTCTGT AATGAAAATTACAGAATCTAC | 204 |
| fwd_saG4 | GTGTGGTTCCAGAACCGGAGGAGTTTTAGTACTCTGTA ATGAAAATTACAGAATCTAC | 205 |
| fwd_spG6 | GAGGCCCCCAGAGCAGCCACGTTTTAGAGCTAGAAATA GCAAGTTAAAATAAGGC | 206 |
| fwd_spG7 | GCCACTGGGGCCTCAACACTCGTTTTAGAGCTAGAAAT AGCAAGTTAAAATAAGGC | 207 |
| fwd_EMX1 | GAGTCCGAGCAGAAGAAGAAGTTTTAGAGCTAGAAATA GCAAGTTAAAATAAGGC | 208 |
| Primers for HTS of on-target sites from all mammalian cell culture experiments | | |
| fwd_CCR5_HTS | ACACTCTTTCCCTACACGACGCTCTTCCGATCTNNNNC AAGTGTGATCACTTGGGTGG | 209 |
| rev_CCR5_HTS | TGGAGTTCAGACGTGTGCTCTTCCGATCTGGATTCCCG AGTAGCAGATG | 210 |
| fwd_EMX1_HTS | ACACTCTTTCCCTACACGACGCTCTTCCGATCTNNNNG GCCCCTAACCCTATGTAGC | 211 |
| rev_EMX1_HTS | TGGAGTTCAGACGTGTGCTCTTCCGATCTCTTCTGCTC GGACTCAGGC | 212 |
| fwd_ND1_HTS | ACACTCTTTCCCTACACGACGCTCTTCCGATCTNNNNC TCACCATCGCTCTTCTACTATG | 213 |
| rev_ND1_HTS | TGGAGTTCAGACGTGTGCTCTTCCGATCTGGCTAGGGT GACTTCATATGAG | 214 |
| fwd_ND2_HTS | ACACTCTTTCCCTACACGACGCTCTTCCGATCTNNNNC GTAAGCCTTCTCCTCACT | 215 |
| rev_ND2_HTS | TGGAGTTCAGACGTGTGCTCTTCCGATCTGTTGAGTAG TAGGAATGCGGTAG | 216 |
| fwd_ND4_HTS | ACACTCTTTCCCTACACGACGCTCTTCCGATCTNNNNG ACTTCAAACTCTACTCCCACTAATAG | 217 |
| rev_ND4_HTS | TGGAGTTCAGACGTGTGCTCTTCCGATCTGTTGTGGTA AATATGTAGAGGGAG | 218 |
| fwd_ND5.1/5.2_ HTS | ACACTCTTTCCCTACACGACGCTCTTCCGATCTNNNNC GGGTCCATCATCCACAAC | 219 |
| rev_ND5.1/5.2_ HTS | TGGAGTTCAGACGTGTGCTCTTCCGATCTAGAGTAATA GATAGGGCTCAGGC | 220 |
| fwd_ND5.3_HTS | ACACTCTTTCCCTACACGACGCTCTTCCGATCTNNNNC TGTAGCATTGTTCGTTACATGG | 221 |
| rev_ND5.3_HTS | TGGAGTTCAGACGTGTGCTCTTCCGATCTCTGATGAGC AAGAAGGATATAATTCC | 222 |
| fwd_ND6_HTS | ACACTCTTTCCCTACACGACGCTCTTCCGATCTNNNNC TCTTTCACCCACAGCACC | 223 |

-continued

| | | |
|---|---|---|
| rev_ND6_HTS | TGGAGTTCAGACGTGTGCTCTTCCGATCTGATTGTTAG CGGTGTGGTCG | 224 |
| fwd_ATP8_HTS | ACACTCTTTCCCTACACGACGCTCTTCCGATCTNNNNC TTTACAGTGAAATGCCCCAAC | 225 |
| rev_ATP8_HTS | TGGAGTTCAGACGTGTGCTCTTCCGATCTGGGGGCAAT GAATGAAGCG | 226 |

Primers for HTS of off-target sites from all mammalian cell culture experiments

| | | |
|---|---|---|
| fwd_5303_HTS | ACACTCTTTCCCTACACGACGCTCTTCCGATCTNNNNG CTAACATGACTAACACCCTTAATTC | 227 |
| rev_5303_HTS | TGGAGTTCAGACGTGTGCTCTTCCGATCTGTAGGAGTA GCGTGGTAAGG | 228 |
| fwd_7994/8115_ HTS | ACACTCTTTCCCTACACGACGCTCTTCCGATCTNNNNC CCCCATTATTCCTAGAACCAG | 229 |
| rev_7994/8115_ HTS | TGGAGTTCAGACGTGTGCTCTTCCGATCTGCTATAGGG TAAATACGGGCC | 230 |
| fwd_8619/8648/ 8720_HTS | ACACTCTTTCCCTACACGACGCTCTTCCGATCTNNNNG ATCATTCTATTTCCCCCTCTATTG | 231 |
| rev_8619/8648/ 8720_HTS | TGGAGTTCAGACGTGTGCTCTTCCGATCTCACTGTGCC CGCTCATAAG | 232 |
| fwd_10192/10205/ 10349_HTS | ACACTCTTTCCCTACACGACGCTCTTCCGATCTNNNNG AAAAATCCACCCCTTACGAG | 233 |
| rev_10192/10205/ 10349_HTS | TGGAGTTCAGACGTGTGCTCTTCCGATCTCGTTTTGTT TAAACTATATACCAATTCGG | 234 |
| fwd_13763_HTS | ACACTCTTTCCCTACACGACGCTCTTCCGATCTNNNNC CCCACCCTTACTAACATTAACG | 235 |
| rev_13763_HTS | TGGAGTTCAGACGTGTGCTCTTCCGATCTGTTTGTTGG TTAGGTAGTTGAGG | 236 |
| fwd_15598/15619/ 15646/15675_ HTS | ACACTCTTTCCCTACACGACGCTCTTCCGATCTNNNNC CTATTCGCCTACACAATTCTC | 237 |
| rev_15598/15619/ 15646/15675_ HTS | TGGAGTTCAGACGTGTGCTCTTCCGATCTGTTGGTATT AGGATTAGGATTGTTGTG | 238 |
| fwd_15950_HTS | ACACTCTTTCCCTACACGACGCTCTTCCGATCTNNNNC TCAAATGGGCCTGTCCTTG | 239 |
| rev_15950_HTS | TGGAGTTCAGACGTGTGCTCTTCCGATCTGTACTACAG GTGGTCAAGTATTTATG | 240 |
| fwd_16363/16393/ 16394_HTS | ACACTCTTTCCCTACACGACGCTCTTCCGATCTNNNNC CATTTACCGTACATAGCACATTAC | 241 |
| rev_16363/16393/ 16394_HTS | TGGAGTTCAGACGTGTGCTCTTCCGATCTCGTGAGTGG TTAATAGGGTGATAG | 242 |

Primers for mtDNA copy number anaylsis by quantitative PCR

| | | |
|---|---|---|
| fwd_ND5.1/5.2_ qPCR | GAACAAGATATTCGAAAAATAGGAGGAC | 243 |
| rev_ND5.1/5.2_ qPCR | GCGGTTTCGATGATGTGG | 244 |
| fwd_ND6_qPCR | CACTCACCAAGACCTCAACC | 245 |
| rev_ND6_qPCR | GAATGATGGTTGTCTTTGGATATACTAC | 246 |
| fwd_ATP8_qPCR | CTTACACTATTCCTCATCACCCAAC | 247 |
| rev_ATP8_qPCR | GTTCATTTTGGTTCTCAGGGTTTG | 248 |

-continued

| | | |
|---|---|---|
| fwd_ß-actin_qPCR | AGGCACCAGGGCGTGAT | 249 |
| rev_ß-actin_qPCR | CAGGGTGAGGATGCCTC | 250 |
| Primers for long-range PCR of whole mitochondrial genome as two amplicons | | |
| fwd_2478-10858 | GCAAATCTTACCCCGCCTG | 251 |
| rev_2478-10858 | AATTAGGCTGTGGGTGGTTG | 252 |
| fwd_2688-10653 | GCCATACTAGTCTTTGCCGC | 253 |
| rev_2688-10653 | GGCAGGTCAATTTCACTGG | 254 |
| Primer for amplification of ND4 gene fragement from ND4-edited cells | | |
| fwd_ND4_PCR | GCCATTCTCATCCAAACC | 255 |
| Rev_ND4_PCR | GGTTGAGGGATAGGAGGAG | 256 |
| Primers for qPCR and RT-qPCR of ND4-edited cells | | |
| fwd_ND4_RT-qPCR | CAAGCTCCATCTGCCTACGA | 257 |
| rev_ND4_RT-qPCR | GCGATTATGAGAATGACTGC | 258 |
| fwd_RNR1_RT-qPCR | ATTACACATGCAAGCATCCC | 259 |
| rev_RNR1_RT-qPCR | CACGAAATTGACCAACCCTG | 260 |
| fwd_ND1_RT-qPCR | TAGCAGAGACCAACCGAACC | 261 |
| rev_ND1_RT-qPCR | ATGAAGAATAGGGCGAAGGG | 262 |
| fwd_ND2_RT-qPCR | CTATCTCGCACCTGAAACAAGC | 263 |
| rev_ND2_RT-qPCR | GGTGGAGTAGATTAGGCGTAGG | 264 |
| fwd_ATP6/8_RT-qPCR | TGTTAGCGGTTAGGCGTA | 265 |
| rev_ATP6/8_RT-qPCR | TTACACCAACCACCCAAC | 266 |
| fwd_CO3_RT-qPCR | TTTACCCTCCTACAAGCC | 267 |
| rev_CO3_RT-qPCR | GCGGATGAAGCAGATAGT | 268 |
| fwd_CYB_RT-qPCR | GCCTGCCTGATCCTCCAAAT | 269 |
| rev_CYB_RT-qPCR | AAGGTAGCGGATGATTCAGCC | 270 |
| fwd_B2M_RT-qPCR_qPCR | CAGGTACTCCAAAGATTCAGG | 271 |
| rev_B2M_RT-qPCR_qPCR | GTCAACTTCAATGTCGGATGG | 272 |

-continued

| Nextera primers for ATAC-seq | | |
|---|---|---|
| i5_common | AATGATACGGCGACCACCGAGATCTACACTCGTCGGCA GCGTCAGATGTG | 273 |
| i7_1 | CAAGCAGAAGACGGCATACGAGATTCGCCTTAGTCTCG TGGGCTCGGAGATGT | 274 |
| i7_2 | CAAGCAGAAGACGGCATACGAGATCTAGTACGGTCTCG TGGGCTCGGAGATGT | 275 |
| i7_3 | CAAGCAGAAGACGGCATACGAGATTTCTGCCTGTCTCG TGGGCTCGGAGATGT | 276 |
| i7_4 | CAAGCAGAAGACGGCATACGAGATGCTCAGGAGTCTCG TGGGCTCGGAGATGT | 277 |
| i7_5 | CAAGCAGAAGACGGCATACGAGATAGGAGTCCGTCTCG TGGGCTCGGAGATGT | 278 |
| i7_6 | CAAGCAGAAGACGGCATACGAGATCATGCCTAGTCTCG TGGGCTCGGAGATGT | 279 |
| i7_7 | CAAGCAGAAGACGGCATACGAGATGTAGAGAGGTCTCG TGGGCTCGGAGATGT | 280 |
| i7_8 | CAAGCAGAAGACGGCATACGAGATCCTCTCTGGTCTCG TGGGCTCGGAGATGT | 281 |
| i7_9 | CAAGCAGAAGACGGCATACGAGATAGCGTAGCGTCTCG TGGGCTCGGAGATGT | 282 |

Split-DddA$_{tox}$-Cas9 Fusions Sequences

G1397 DddA$_{tox}$-N (SEQ ID NO: 283)

GGCAGCTACGCCCTGGGTCCGTATCAGATTAGCGCCCCGCAGCTGCCAGCTTACAATGGTCAGA

CCGTGGGTACCTTCTACTATGTGAACGACGCGGGCGGTCTGGAGAGCAAGGTGTTTAGCAGCGG

CGGTCCAACCCCGTACCCAAACTATGCCAATGCCGGTCATGTGGAGGGTCAGAGCGCCCTGTTC

ATGCGTGATAACGGCATCAGCGAGGGTCTGGTGTTCCACAACAACCCGGAAGGCACCTGCGGTT

TTTGCGTGAACATGACCGAGACCCTGCTGCCGGAAAACGCGAAAATGACCGTGGTGCCGCCGGA

AGGT

Translated amino acid sequence:

(SEQ ID NO: 284)

GSYALGPYQISAPOLPAYNGQTVGTFYYVNDAGGLESKVFSSGGPTPYPNYANAGHVEGQSALF

MRDNGISEGLVFHNNPEGTCGFCVNMTETLLPENAKMTVVPPEG

G1397 DddA$_{tox}$-C (SEQ ID NO: 285)

GCCATTCCAGTGAAGCGCGGCGCTACCGGTGAAACCAAAGTGTTTACCGGTAACAGCAACAGCC

CGAAGAGCCCGACCAAAGGCGGTTGC (SEQ ID NO: 286)

Translated amino acid sequence:
AIPVKRGATGETKVFTGNSNSPKSPTKGGC

G1333 DddA$_{tox}$-N-SaKKH-Cas9(D10A)-*UGI*

(SEQ ID NO: 287)

GGCAGCTACGCCCTGGGTCCGTATCAGATTAGCGCCCCGCAGCTGCCAGCTTACAATGGTCAGA

CCGTGGGTACCTTCTACTATGTGAACGACGCGGGCGGTCTGGAGAGCAAGGTGTTTAGCAGCGG

CGGTTCTGGTGGTTCTTCTGGTGGTTCTAGCGGCAGCGAGACTCCCGGGACCTCAGAGTCCGCC

ACACCCGAAAGTAGTGGCGGCAGCAGCGGCGGCAGCGGGAAACGGAACTACATCCTGGGGCTTG

-continued

CCATTGGGATAACCAGCGTTGGCTACGGAATTATTGATTATGAGACACGCGATGTGATTGACGC

CGGGGTTAGGCTGTTCAAAGAGGCCAACGTTGAAAACAACGAGGGAAGACGGAGTAAGCGCGGA

GCAAGAAGACTCAAGCGCAGACGGAGACATCGGATTCAGAGGGTGAAAAAGCTGCTCTTCGATT

ACAATCTCCTGACCGATCATAGTGAGCTGAGCGGAATCAACCCCTACGAGGCGCGAGTGAAAGG

GCTTTCCCAGAAGCTGTCCGAAGAGGAGTTCTCCGCCGCGTTGCTGCACCTGGCCAAACGGAGG

GGGGTTCACAATGTAAACGAAGTGGAGGAGGACACGGGCAATGAACTTAGTACGAAAGAACAGA

TCAGTAGGAACTCTAAGGCTCTCGAAGAGAAATACGTCGCTGAGTTGCAGCTTGAGAGACTGAA

AAAAGACGGCGAAGTACGCGGATCTATTAATAGGTTCAAGACTTCAGATTACGTAAAGGAAGCC

AAGCAGCTCCTGAAAGTACAGAAAGCGTACCATCAGCTCGATCAGAGCTTCATCGATACCTACA

TAGATTTGCTGGAGACACGGAGGACATACTACGAGGGCCCAGGGGAAGGATCTCCTTTTGGGTG

GAAGGACATCAAGGAATGGTACGAGATGCTTATGGGACATTGTACATATTTTCCGGAGGAGCTC

AGGAGCGTCAAGTACGCCTACAATGCCGACCTGTACAATGCCCTCAATGACCTCAATAACCTCG

TGATTACCAGGGACGAGAACGAGAAGCTGGAGTACTATGAAAAGTTCCAGATTATCGAGAATGT

GTTTAAGCAGAAGAAGAAGCCGACACTTAAGCAGATTGCAAAGGAAATCCTCGTGAATGAGGAA

GATATCAAGGGATACAGAGTGACAAGTACAGGCAAGCCCGAGTTCACAAATCTGAAGGTGTACC

ACGATATTAAGGACATAACCGCACGAAAGGAGATAATCGAAAACGCTGAGCTCCTCGATCAGAT

CGCAAAAATTCTTACCATCTACCAGTCTAGTGAGGACATTCAGGAGGAACTGACTAATCTGAAC

AGTGAGCTCACCCAAGAGGAAATTGAGCAGATTTCAAACCTGAAAGGCTACACCGGGACGCACA

ATCTGAGCCTCAAAGCAATCAACCTCATTCTGGATGAACTTTGGCACACAAATGACAACCAAAT

TGCCATATTCAACCGCCTGAAACTGGTGCCAAAAAAAGTGGATCTGTCACAGCAAAAGGAAATC

CCTACAACCTTGGTTGACGATTTTATTCTGTCCCCCGTTGTCAAGCGGAGCTTCATCCAGTCAA

TCAAGGTGATCAATGCCATCATTAAAAAATACGGATTGCCAAACGATATAATTATCGAGCTTGC

ACGAGAGAAGAACTCAAAGGACGCCCAGAAGATGATTAACGAAATGCAGAAGCGCAACCGCCAG

ACAAACGAACGCATAGAGGAAATTATAAGAACAACCGGCAAAGAGAATGCCAAGTATCTGATCG

AGAAAATCAAGCTGCACGACATGCAAGAAGGCAAGTGCCTGTACTCTCTGGAAGCTATCCCACT

CGAAGATCTGCTGAATAATCCATTCAATTACGAGGTGGACCACATCATCCCTAGATCCGTAAGC

TTTGACAATTCCTTCAATAACAAAGTTCTGGTTAAACAGGAGGAAAATTCTAAAAAAGGGAACC

GGACCCCGTTCCAGTACCTGAGCTCCAGTGACAGCAAGATTAGCTACGAGACTTTTAAGAAACA

TATTCTGAATCTGGCCAAAGGCAAAGGCAGGATCAGCAAGACCAAGAAGGAGTACCTCCTCGAA

GAACGCGACATTAACAGATTTAGTGTGCAGAAAGATTTCATCAACCGAAACCTTGTCGATACTC

GGTACGCCACGAGAGGCCTGATGAATCTCCTCAGGAGCTACTTCCGCGTCAATAATCTGGACGT

TAAAGTCAAGAGCATAAATGGGGGATTCACCAGCTTTCTGAGGAGAAAGTGGAAGTTTAAGAAG

GAACGAAACAAAGGATACAAGCACCATGCTGAGGATGCTTTGATCATCGCTAACGCGGACTTTA

TCTTTAAGGAATGGAAAAAGCTGGATAAGGCAAAGAAAGTGATGGAAAACCAGATGTTCGAGGA

GAAGCAGGCAGAGTCAATGCCTGAGATCGAGACAGAGCAGGAATACAAGGAAATTTTCATCACC

CCTCATCAGATTAAACACATAAAGGACTTCAAAGACTATAAATACTCTCATAGGGTGGACAAAA

AACCCAATCGCAAGCTCATTAATGACACCCTGTACTCAACACGGAAGGATGATAAAGGTAATAC

CTTGATTGTGAATAATCTTAATGGATTGTATGACAAAGATAACGACAAGCTCAAGAAGCTGATC

AACAAGTCTCCAGAGAAGCTCCTTATGTATCACCACGACCCACAGACTTATCAGAAATTGAAAC

-continued

TGATCATGGAGCAATACGGGGATGAGAAGAACCCACTCTACAAATATTATGAGGAAACAGGTAA

TTACCTGACCAAGTACTCCAAGAAGGATAACGGACCAGTGATCAAAAAGATAAAGTACTATGGC

AACAAACTTAATGCGCATTTGGACATAACTGACGATTACCCCAATTCTCGAAACAAGGTTGTGA

AGCTCTCCCTGAAGCCTTATAGATTTGACGTGTACCTGGATAATGGGGTTTATAAATTCGTCAC

CGTGAAAAATCTGGACGTGATCAAAAAGGAGAACTATTATGAAGTAAACTCAAAGTGCTATGAG

GAGGCGAAGAAGCTGAAGAAGATCTCCAATCAGGCCGAGTTCATCGCTTCCTTCTATAAGAACG

ATCTCATCAAGATCAATGGAGAGCTTTATCGCGTCATTGGTGTGAACAATGACTTGCTGAACAG

GATCGAAGTCAATATGATAGACATTACCTACCGGGAGTATCTCGAAAACATGAATGATAAACGG

CCGCCTCACATCATCAAGACAATCGCATCTAAAACTCAGTCAATAAAAAAGTACTCTACCGATA

TCCTGGGGAATCTCTATGAAGTGAAGTCAAAGAAGCACCCACAAATCATTAAAAAAGGTGGATC

CCCCAAGAAGAAGAGGAAAGTCTCGAGCGACTACAAAGACCATGACGGTGATTATAAAGATCAT

GACATCGATTACAAGGATGACGATGACAAGTCTGGTGGTTCTACTAATCTGTCAGATATTATTG

AGAAGTCATTGGGAACAAGCCGGAAAGCGATATACTCGTGCACACCGCCTACGACGAGAGCACC

GACGAGAATGTCATGCTTCTGACTAGCGACGCCCCTGAATACAAGCCTTGGGCTCTGGTCATAC

AGGATAGCAACGGTGAGAACAAGATTAAGATGCTCTCTGGTGGTTCTCCCAAGAAGAAGAGGAA

AGTC

Translated amino acid sequence:

(SEQ ID NO: 288)

GSYALGPYQISAPQLPAYNGOTVGTFYYVNDAGGLESKVFSSGGSGGSSGGSSGSETPGTSESA

TPESSGGSSGGSGKRNYILGLAIGITSVGYGIIDYETRDVIDAGVRLFKEANVENNEGRRSKRG

ARRLKRRRRHRIQRVKKLLFDYNLLTDHSELSGINPYEARVKGLSQKLSEEEFSAALLHLAKRR

GVHNVNEVEEDTGNELSTKEQISRNSKALEEKYVAELQLERLKKDGEVRGSINRFKTSDYVKEA

KQLLKVOKAYHOLDQSFIDTYIDLLETRRTYYEGPGEGSPFGWKDIKEWYEMLMGHCTYFPEEL

RSVKYAYNADLYNALNDLNNLVITRDENEKLEYYEKFQIIENVFKQKKKPTLKQIAKEILVNEE

DIKGYRVTSTGKPEFTNLKVYHDIKDITARKEIIENAELLDQIAKILTIYQSSEDIQEELTNLN

SELTQEEIEQISNLKGYTGTHNLSLKAINLILDELWHINDNQIAIFNRLKLVPKKVDLSQQKEI

PTTLVDDFILSPVVKRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNPFNYEVDHIIPRSVS

FDNSFNNKVLVKQEENSKKGNRTPFQYLSSSDSKISYETFKKHILNLAKGKGRISKTKKEYLLE

ERDINRFSVQKDFINRNLVDTRYATRGLMNLLRSYFRVNNLDVKVKSINGGFTSFLRRKWKFKK

ERNKGYKHHAEDALIIANADFIFKEWKKLDKAKKVMENOMFEEKQAESMPEIETEQEYKEIFIT

PHQIKHIKDFKDYKYSHRVDKKPNRKLINDTLYSTRKDDKGNTLIVNNLNGLYDKDNDKLKKLI

NKSPEKLLMYHHDPQTYQKLKLIMEQYGDEKNPLYKYYEETGNYLTKYSKKDNGPVIKKIKYYG

NKLNAHLDITDDYPNSRNKVVKLSLKPYRFDVYLDNGVYKFVTVKNLDVIKKENYYEVNSKCYE

EAKKLKKISNQAEFIASFYKNDLIKINGELYRVIGVNNDLLNRIEVNMIDITYREYLENMNDKR

PPHIIKTIASKTQSIKKYSTDILGNLYEVKSKKHPQIIKKGGSPKKKRKVSSDYKDHDGDYKDH

-continued

DIDYKDDDDKSGGSTNLSDIIEKETGKQLVIQESILMLPEEVEEVIGNKPESDILVHTAYDEST

DENVMLLTSDAPEYKPWALVIQDSNGENKIKMLSGGSPKKKRKV

G1333 DddA$_{tox}$-C-SaKKH-Cas9(D10A)-*UGI*

(SEQ ID NO: 289)

CCAACCCCGTACCCAAACTATGCCAATGCCGGTCATGTGGAGGGTCAGAGCGCCCTGTTCATGC

GTGATAACGGCATCAGCGAGGGTCTGGTGTTCCACAACAACCCGGAAGGCACCTGCGGTTTTTG

CGTGAACATGACCGAGACCCTGCTGCCGGAAAACGCGAAAATGACCGTGGTGCCGCCGGAAGGT

GCCATTCCAGTGAAGCGCGGCGCTACCGGTGAAACCAAAGTGTTTACCGGTAACAGCAACAGCC

CGAAGAGCCCGACCAAAGGCGGTTGCTCTGGTGGTTCTTCTGGTGGTTCTAGCGGCAGCGAGAC

TCCCGGGACCTCAGAGTCCGCCACACCCGAAAGTAGTGGCGGCAGCAGCGGCGGCAGCGGGAAA

CGGAACTACATCCTGGGGCTTGCCATTGGGATAACCAGCGTTGGCTACGGAATTATTGATTATG

AGACACGCGATGTGATTGACGCCGGGGTTAGGCTGTTCAAAGAGGCCAACGTTGAAAACAACGA

GGGAAGACGGAGTAAGCGCGGAGCAAGAAGACTCAAGCGCAGACGGAGACATCGGATTCAGAGG

GTGAAAAAGCTGCTCTTCGATTACAATCTCCTGACCGATCATAGTGAGCTGAGCGGAATCAACC

CCTACGAGGCGCGAGTGAAAGGGCTTTCCCAGAAGCTGTCCGAAGAGGAGTTCTCCGCCGCGTT

GCTGCACCTGGCCAAACGGAGGGGGGTTCACAATGTAAACGAAGTGGAGGAGGACACGGGCAAT

GAACTTAGTACGAAAGAACAGATCAGTAGGAACTCTAAGGCTCTCGAAGAGAAATACGTCGCTG

AGTTGCAGCTTGAGAGACTGAAAAAAGACGGCGAAGTACGCGGATCTATTAATAGGTTCAAGAC

TTCAGATTACGTAAAGGAAGCCAAGCAGCTCCTGAAAGTACAGAAAGCGTACCATCAGCTCGAT

CAGAGCTTCATCGATACCTACATAGATTTGCTGGAGACACGGAGGACATACTACGAGGGCCCAG

GGGAAGGATCTCCTTTTGGGTGGAAGGACATCAAGGAATGGTACGAGATGCTTATGGGACATTG

TACATATTTTCCGGAGGAGCTCAGGAGCGTCAAGTACGCCTACAATGCCGACCTGTACAATGCC

CTCAATGACCTCAATAACCTCGTGATTACCAGGGACGAGAACGAGAAGCTGGAGTACTATGAAA

AGTTCCAGATTATCGAGAATGTGTTTAAGCAGAAGAAGAAGCCGACACTTAAGCAGATTGCAAA

GGAAATCCTCGTGAATGAGGAAGATATCAAGGGATACAGAGTGACAAGTACAGGCAAGCCCGAG

TTCACAAATCTGAAGGTGTACCACGATATTAAGGACATAACCGCACGAAAGGAGATAATCGAAA

ACGCTGAGCTCCTCGATCAGATCGCAAAAATTCTTACCATCTACCAGTCTAGTGAGGACATTCA

GGAGGAACTGACTAATCTGAACAGTGAGCTCACCCAAGAGGAAATTGAGCAGATTTCAAACCTG

AAAGGCTACACCGGGACGCACAATCTGAGCCTCAAAGCAATCAACCTCATTCTGGATGAACTTT

GGCACACAAATGACAACCAAATTGCCATATTCAACCGCCTGAAACTGGTGCCAAAAAAAGTGGA

TCTGTCACAGCAAAAGGAAATCCCTACAACCTTGGTTGACGATTTTATTCTGTCCCCCGTTGTC

AAGCGGAGCTTCATCCAGTCAATCAAGGTGATCAATGCCATCATTAAAAAATACGGATTGCCAA

ACGATATAATTATCGAGCTTGCACGAGAGAAGAACTCAAAGGACGCCCAGAAGATGATTAACGA

AATGCAGAAGCGCAACCGCCAGACAAACGAACGCATAGAGGAAATTATAAGAACAACCGGCAAA

GAGAATGCCAAGTATCTGATCGAGAAAATCAAGCTGCACGACATGCAAGAAGGCAAGTGCCTGT

ACTCTCTGGAAGCTATCCCACTCGAAGATCTGCTGAATAATCCATTCAATTACGAGGTGGACCA

CATCATCCCTAGATCCGTAAGCTTTGACAATTCCTTCAATAACAAAGTTCTGGTTAAACAGGAG

GAAAATTCTAAAAAAGGGAACCGGACCCCGTTCCAGTACCTGAGCTCCAGTGACAGCAAGATTA

GCTACGAGACTTTTAAGAAACATATTCTGAATCTGGCCAAAGGCAAAGGCAGGATCAGCAAGAC

CAAGAAGGAGTACCTCCTCGAAGAACGCGACATTAACAGATTTAGTGTGCAGAAAGATTTCATC

-continued

AACCGAAACCTTGTCGATACTCGGTACGCCACGAGAGGCCTGATGAATCTCCTCAGGAGCTACT

TCCGCGTCAATAATCTGGACGTTAAAGTCAAGAGCATAAATGGGGGATTCACCAGCTTTCTGAG

GAGAAAGTGGAAGTTTAAGAAGGAACGAAACAAAGGATACAAGCACCATGCTGAGGATGCTTTG

ATCATCGCTAACGCGGACTTTATCTTTAAGGAATGGAAAAAGCTGGATAAGGCAAAGAAAGTGA

TGGAAAACCAGATGTTCGAGGAGAAGCAGGCAGAGTCAATGCCTGAGATCGAGACAGAGCAGGA

ATACAAGGAAATTTTCATCACCCCTCATCAGATTAAACACATAAAGGACTTCAAAGACTATAAA

TACTCTCATAGGGTGGACAAAAAACCCAATCGCAAGCTCATTAATGACACCCTGTACTCAACAC

GGAAGGATGATAAAGGTAATACCTTGATTGTGAATAATCTTAATGGATTGTATGACAAAGATAA

CGACAAGCTCAAGAAGCTGATCAACAAGTCTCCAGAGAAGCTCCTTATGTATCACCACGACCCA

CAGACTTATCAGAAATTGAAACTGATCATGGAGCAATACGGGGATGAGAAGAACCCACTCTACA

AATATTATGAGGAAACAGGTAATTACCTGACCAAGTACTCCAAGAAGGATAACGGACCAGTGAT

CAAAAAGATAAAGTACTATGGCAACAAACTTAATGCGCATTTGGACATAACTGACGATTACCCC

AATTCTCGAAACAAGGTTGTGAAGCTCTCCCTGAAGCCTTATAGATTTGACGTGTACCTGGATA

ATGGGGTTTATAAATTCGTCACCGTGAAAAATCTGGACGTGATCAAAAAGGAGAACTATTATGA

AGTAAACTCAAAGTGCTATGAGGAGGCGAAGAAGCTGAAGAAGATCTCCAATCAGGCCGAGTTC

ATCGCTTCCTTCTATAAGAACGATCTCATCAAGATCAATGGAGAGCTTTATCGCGTCATTGGTG

TGAACAATGACTTGCTGAACAGGATCGAAGTCAATATGATAGACATTACCTACCGGGAGTATCT

CGAAAACATGAATGATAAACGGCCGCCTCACATCATCAAGACAATCGCATCTAAAACTCAGTCA

ATAAAAAAGTACTCTACCGATATCCTGGGGAATCTCTATGAAGTGAAGTCAAAGAAGCACCCAC

AAATCATTAAAAAAGGTGGATCCCCCAAGAAGAAGAGGAAAGTCTCGAGCGACTACAAAGACCA

TGACGGTGATTATAAAGATCATGACATCGATTACAAGGATGACGATGACAAGTCTGGTGGTTCT

ACTAATCTGTCAGATATTATTGAAAAGGAGACCGGTAAGCAACTGGTTATCCAGGAATCCATCC

TCATGCTCCCAGAGGAGGTGGAAGAAGTCATTGGGAACAAGCCGGAAAGCGATATACTCGTGCA

CACCGCCTACGACGAGAGCACCGACGAGAATGTCATGCTTCTGACTAGCGACGCCCCTGAATAC

AAGCCTTGGGCTCTGGTCATACAGGATAGCAACGGTGAGAACAAGATTAAGATGCTCTCTGGTG

GTTCTCCCAAGAAGAAGAGGAAAGTC

Translated amino acid sequence:

(SEQ ID NO: 290)

PTPYPNYANAGHVEGQSALFMRDNGISEGLVFHNNPEGTCGFCVNMTETLLPENAKMTVVPPEG

AIPVKRGATGETKVFTGNSNSPKSPTKGGCSGGSSGGSSGSETPGTSESATPESSGGSSGGSGK

RNYILGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVEEDTGN

ELSTKEQISRNSKALEEKYVAELQLERLKKDGEVRGSINRFKTSDYVKEAKOLLKVOKAYHOLD

QSFIDTYIDLLETRRTYYEGPGEGSPFGWKDIKEWYEMLMGHCTYFPEELRSVKYAYNADLYNA

LNDLNNLVITRDENEKLEYYEKFQIIENVFKQKKKPTLKQIAKEILVNEEDIKGYRVTSTGKPE

FTNLKVYHDIKDITARKEIIENAELLDQIAKILTIYQSSEDIQEELTNLNSELTQEEIEQISNL

KGYTGTHNLSLKAINLILDELWHTNDNOIAIFNRLKLVPKKVDLSQQKEIPTTLVDDFILSPVV

KRSFIQSIKVINAIIKKYGLPNDIIIELAREKNSKDAQKMINEMQKRNRQTNERIEEIIRTTGK

ENAKYLIEKIKLHDMQEGKCLYSLEAIPLEDLLNNPFNYEVDHIIPRSVSFDNSFNNKVLVKQE

-continued

ENSKKGNRTPFQYLSSSDSKISYETFKKHILNLAKGKGRISKTKKEYLLEERDINRFSVQKDFI

NRNLVDTRYATRGLMNLLRSYFRVNNLDVKVKSINGGFTSFLRRKWKFKKERNKGYKHHAEDAL

IIANADFIFKEWKKLDKAKKVMENQMFEEKQAESMPEIETEQEYKEIFITPHQIKHIKDFKDYK

YSHRVDKKPNRKLINDTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYYGNKLNAHLDITDDYP

NSRNKVVKLSLKPYRFDVYLDNGVYKFVTVKNLDVIKKENYYEVNSKCYEEAKKLKKISNQAEF

IASFYKNDLIKINGELYRVIGVNNDLLNRIEVNMIDITYREYLENMNDKRPPHIIKTIASKTQS

IKKYSTDILGNLYEVKSKKHPQIIKKGGSPKKKRKVSSDYKDHDGDYKDHDIDYKDDDDKSGGS

TNLSDIIEKETGKQLVIQESILMLPEEVEEVIGNKPESDILVHTAYDESTDENVMLLTSDAPEY

KPWALVIQDSNGENKIKMLSGGSPKKKRKV

G1333 DddA$_{tox}$-N-dSpCas9-2x-UGI (SEQ ID NO: 291)

AAACGGACAGCCGACGGAAGCGAGTTCGAGTCACCAAAGAAGAAGCGGAAAGTCGGCAGCTACG

CCCTGGGTCCGTATCAGATTAGCGCCCCGCAGCTGCCAGCTTACAATGGTCAGACCGTGGGTAC

CTTCTACTATGTGAACGACGCGGGCGGTCTGGAGAGCAAGGTGTTTAGCAGCGGCGGTTCTGGA

GGATCTAGCGGAGGATCCTCTGGCAGCGAGACACCAGGAACAAGCGAGTCAGCAACACCAGAGA

GCAGTGGCGGCAGCAGCGGCGGCAGCGACAAGAAGTACAGCATCGGCCTGGCCATCGGCACCAA

CTCTGTGGGCTGGGCCGTGATCACCGACGAGTACAAGGTGCCCAGCAAGAAATTCAAGGTGCTG

GGCAACACCGACCGGCACAGCATCAAGAAGAACCTGATCGGAGCCCTGCTGTTCGACAGCGGCG

AAACAGCCGAGGCCACCCGGCTGAAGAGAACCGCCAGAAGAAGATACACCAGACGGAAGAACCG

GATCTGCTATCTGCAAGAGATCTTCAGCAACGAGATGGCCAAGGTGGACGACAGCTTCTTCCAC

AGACTGGAAGAGTCCTTCCTGGTGGAAGAGGATAAGAAGCACGAGCGGCACCCCATCTTCGGCA

ACATCGTGGACGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCACATGATCAAG

TTCCGGGGCCACTTCCTGATCGAGGGCGACCTGAACCCCGACAACAGCGACGTGGACAAGCTGT

TCATCCAGCTGGTGCAGACCTACAACCAGCTGTTCGAGGAAAACCCCATCAACGCCAGCGGCGT

GGACGCCAAGGCCATCCTGTCTGCCAGACTGAGCAAGAGCAGACGGCTGGAAAATCTGATCGCC

CAGCTGCCCGGCGAGAAGAAGAATGGCCTGTTCGGAAACCTGATTGCCCTGAGCCTGGGCCTGA

CCCCCAACTTCAAGAGCAACTTCGACCTGGCCGAGGATGCCAAACTGCAGCTGAGCAAGGACAC

CTACGACGACGACCTGGACAACCTGCTGGCCCAGATCGGCGACCAGTACGCCGACCTGTTTCTG

GCCGCCAAGAACCTGTCCGACGCCATCCTGCTGAGCGACATCCTGAGAGTGAACACCGAGATCA

CCAAGGCCCCCCTGAGCGCCTCTATGATCAAGAGATACGACGAGCACCACCAGGACCTGACCCT

GCTGAAAGCTCTCGTGCGGCAGCAGCTGCCTGAGAAGTACAAAGAGATTTTCTTCGACCAGAGC

AAGAACGGCTACGCCGGCTACATTGACGGCGGAGCCAGCCAGGAAGAGTTCTACAAGTTCATCA

AGCCCATCCTGGAAAAGATGGACGGCACCGAGGAACTGCTCGTGAAGCTGAACAGAGAGGACCT

GCTGCGGAAGCAGCGGACCTTCGACAACGGCAGCATCCCCCACCAGATCCACCTGGGAGAGCTG

CACGCCATTCTGCGGCGGCAGGAAGATTTTTACCCATTCCTGAAGGACAACCGGGAAAAGATCG

AGAAGATCCTGACCTTCCGCATCCCCTACTACGTGGGCCCTCTGGCCAGGGGAAACAGCAGATT

CGCCTGGATGACCAGAAAGAGCGAGGAAACCATCACCCCCTGGAACTTCGAGGAAGTGGTGGAC

AAGGGCGCTTCCGCCCAGAGCTTCATCGAGCGGATGACCAACTTCGATAAGAACCTGCCCAACG

AGAAGGTGCTGCCCAAGCACAGCCTGCTGTACGAGTACTTCACCGTGTATAACGAGCTGACCAA

-continued

AGTGAAATACGTGACCGAGGGAATGAGAAAGCCCGCCTTCCTGAGCGGCGAGCAGAAAAAGGCC
ATCGTGGACCTGCTGTTCAAGACCAACCGGAAAGTGACCGTGAAGCAGCTGAAAGAGGACTACT
TCAAGAAAATCGAGTGCTTCGACTCCGTGGAAATCTCCGGCGTGGAAGATCGGTTCAACGCCTC
CCTGGGCACATACCACGATCTGCTGAAAATTATCAAGGACAAGGACTTCCTGGACAATGAGGAA
AACGAGGACATTCTGGAAGATATCGTGCTGACCCTGACACTGTTTGAGGACAGAGAGATGATCG
AGGAACGGCTGAAAACCTATGCCCACCTGTTCGACGACAAAGTGATGAAGCAGCTGAAGCGGCG
GAGATACACCGGCTGGGGCAGGCTGAGCCGGAAGCTGATCAACGGCATCCGGGACAAGCAGTCC
GGCAAGACAATCCTGGATTTCCTGAAGTCCGACGGCTTCGCCAACAGAAACTTCATGCAGCTGA
TCCACGACGACAGCCTGACCTTTAAAGAGGACATCCAGAAAGCCCAGGTGTCCGGCCAGGGCGA
TAGCCTGCACGAGCACATTGCCAATCTGGCCGGCAGCCCCGCCATTAAGAAGGGCATCCTGCAG
ACAGTGAAGGTGGTGGACGAGCTCGTGAAAGTGATGGGCCGGCACAAGCCCGAGAACATCGTGA
TCGAAATGGCCAGAGAGAACCAGACCACCCAGAAGGGACAGAAGAACAGCCGCGAGAGAATGAA
GCGGATCGAAGAGGGCATCAAAGAGCTGGGCAGCCAGATCCTGAAAGAACACCCCGTGGAAAAC
ACCCAGCTGCAGAACGAGAAGCTGTACCTGTACTACCTGCAGAATGGGCGGGATATGTACGTGG
ACCAGGAACTGGACATCAACCGGCTGTCCGACTACGATGTGGACGCTATCGTGCCTCAGAGCTT
TCTGAAGGACGACTCCATCGACAACAAGGTGCTGACCAGAAGCGACAAGAACCGGGGCAAGAGC
GACAACGTGCCCTCCGAAGAGGTCGTGAAGAAGATGAAGAACTACTGGCGGCAGCTGCTGAACG
CCAAGCTGATTACCCAGAGAAAGTTCGACAATCTGACCAAGGCCGAGAGAGGCGGCCTGAGCGA
ACTGGATAAGGCCGGCTTCATCAAGAGACAGCTGGTGGAAACCCGGCAGATCACAAAGCACGTG
GCACAGATCCTGGACTCCCGGATGAACACTAAGTACGACGAGAATGACAAGCTGATCCGGGAAG
TGAAAGTGATCACCCTGAAGTCCAAGCTGGTGTCCGATTTCCGGAAGGATTTCCAGTTTTACAA
AGTGCGCGAGATCAACAACTACCACCACGCCCACGACGCCTACCTGAACGCCGTCGTGGGAACC
GCCCTGATCAAAAAGTACCCTAAGCTGGAAAGCGAGTTCGTGTACGGCGACTACAAGGTGTACG
ACGTGCGGAAGATGATCGCCAAGAGCGAGCAGGAAATCGGCAAGGCTACCGCCAAGTACTTCTT
CTACAGCAACATCATGAACTTTTTCAAGACCGAGATTACCCTGGCCAACGGCGAGATCCGGAAG
CGGCCTCTGATCGAGACAAACGGCGAAACCGGGGAGATCGTGTGGGATAAGGGCCGGGATTTTG
CCACCGTGCGGAAAGTGCTGAGCATGCCCCAAGTGAATATCGTGAAAAAGACCGAGGTGCAGAC
AGGCGGCTTCAGCAAAGAGTCTATCCTGCCCAAGAGGAACAGCGATAAGCTGATCGCCAGAAAG
AAGGACTGGGACCCTAAGAAGTACGGCGGCTTCGACAGCCCCACCGTGGCCTATTCTGTGCTGG
TGGTGGCCAAAGTGGAAAAGGGCAAGTCCAAGAAACTGAAGAGTGTGAAAGAGCTGCTGGGGAT
CACCATCATGGAAAGAAGCAGCTTCGAGAAGAATCCCATCGACTTTCTGGAAGCCAAGGGCTAC
AAAGAAGTGAAAAAGGACCTGATCATCAAGCTGCCTAAGTACTCCCTGTTCGAGCTGGAAAACG
GCCGGAAGAGAATGCTGGCCTCTGCCGGCGAACTGCAGAAGGGAAACGAACTGGCCCTGCCCTC
CAAATATGTGAACTTCCTGTACCTGGCCAGCCACTATGAGAAGCTGAAGGGCTCCCCCGAGGAT
AATGAGCAGAAACAGCTGTTTGTGGAACAGCACAAGCACTACCTGGACGAGATCATCGAGCAGA
TCAGCGAGTTCTCCAAGAGAGTGATCCTGGCCGACGCTAATCTGGACAAAGTGCTGTCCGCCTA
CAACAAGCACCGGGATAAGCCCATCAGAGAGCAGGCCGAGAATATCATCCACCTGTTTACCCTG
ACCAATCTGGGAGCCCCTGCCGCCTTCAAGTACTTTGACACCACCATCGACCGGAAGAGGTACA
CCAGCACCAAAGAGGTGCTGGACGCCACCCTGATCCACCAGAGCATCACCGGCCTGTACGAGAC

-continued

ACGGATCGACCTGTCTCAGCTGGGAGGTGACAGCGGCGGGAGCGGCGGGAGCGGGGGGAGCACT

AATCTGAGCGACATCATTGAGAAGGAGACTGGGAAACAGCTGGTCATTCAGGAGTCCATCCTGA

TGCTGCCTGAGGAGGTGGAGGAAGTGATCGGCAACAAGCCAGAGTCTGACATCCTGGTGCACAC

CGCCTACGACGAGTCCACAGATGAGAATGTGATGCTGCTGACCTCTGACGCCCCCGAGTATAAG

CCTTGGGCCCTGGTCATCCAGGATTCTAACGGCGAGAATAAGATCAAGATGCTGAGCGGAGGAT

CCGGAGGATCTGGAGGCAGCACCAACCTGTCTGACATCATCGAGAAGGAGACAGGCAAGCAGCT

GGTCATCCAGGAGAGCATCCTGATGCTGCCCGAAGAAGTCGAAGAAGTGATCGGAAACAAGCCT

GAGAGCGATATCCTGGTCCATACCGCCTACGACGAGAGTACCGACGAAAATGTGATGCTGCTGA

CATCCGACGCCCCAGAGTATAAGCCCTGGGCTCTGGTCATCCAGGATTCCAACGGAGAGAACAA

AATCAAAATGCTGTCTGGCGGCTCAAAAAGAACCGCCGACGGCAGCGAATTCGAGCCCAAGAAG

AAGAGGAAAGTC

Translated amino acid sequence:

(SEQ ID NO: 292)

KRTADGSEFESPKKKRKVGSYALGPYQISAPOLPAYNGQTVGTFYYVNDAGGLESKVFSSGGSG

GSSGGSSGSETPGTSESATPESSGGSSGGSDKKYSIGLAIGTNSVGWAVITDEYKVPSKKFKVL

GNTDRHSIKKNLIGALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKADLRLIYLALAHMIK

FRGHFLIEGDLNPDNSDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLDNLLAQIGDQYADLFL

AAKNLSDAILLSDILRVNTEITKAPLSASMIKRYDEHHODLTLLKALVROOLPEKYKEIFFDQS

KNGYAGYIDGGASQEEFYKFIKPILEKMDGTEELLVKLNREDLLRKORTFDNGSIPHQIHLGEL

HAILRRQEDFYPFLKDNREKIEKILTFRIPYYVGPLARGNSRFAWMTRKSEETITPWNFEEVVD

KGASAQSFIERMTNFDKNLPNEKVLPKHSLLYEYFTVYNELTKVKYVTEGMRKPAFLSGEQKKA

IVDLLFKTNRKVTVKOLKEDYFKKIECFDSVEISGVEDRFNASLGTYHDLLKIIKDKDFLDNEE

NEDILEDIVLTLTLFEDREMIEERLKTYAHLFDDKVMKOLKRRRYTGWGRLSRKLINGIRDKOS

GKTILDFLKSDGFANRNFMOLIHDDSLTFKEDIQKAQVSGQGDSLHEHIANLAGSPAIKKGILQ

TVKVVDELVKVMGRHKPENIVIEMARENOTTOKGOKNSRERMKRIEEGIKELGSQILKEHPVEN

TQLQNEKLYLYYLONGRDMYVDQELDINRLSDYDVDAIVPQSFLKDDSIDNKVLTRSDKNRGKS

DNVPSEEVVKKMKNYWROLLNAKLITORKFDNLTKAERGGLSELDKAGFIKROLVETROITKHV

AQILDSRMNTKYDENDKLIREVKVITLKSKLVSDFRKDFQFYKVREINNYHHAHDAYLNAVVGT

ALIKKYPKLESEFVYGDYKVYDVRKMIAKSEQEIGKATAKYFFYSNIMNFFKTEITLANGEIRK

RPLIETNGETGEIVWDKGRDFATVRKVLSMPQVNIVKKTEVQTGGFSKESILPKRNSDKLIARK

KDWDPKKYGGFDSPTVAYSVLVVAKVEKGKSKKLKSVKELLGITIMERSSFEKNPIDFLEAKGY

KEVKKDLIIKLPKYSLFELENGRKRMLASAGELQKGNELALPSKYVNFLYLASHYEKLKGSPED

NEQKOLFVEQHKHYLDEIIEQISEFSKRVILADANLDKVLSAYNKHRDKPIREQAENIIHLFTL

TNLGAPAAFKYFDTTIDRKRYTSTKEVLDATLIHQSITGLYETRIDLSQLGGDSGGSGGSGGST

NLSDIIEKETGKOLVIQESILMLPEEVEEVIGNKPESDILVHTAYDESTDENVMLLTSDAPEYK

PWALVIQDSNGENKIKMLSGGSGGSGGSTNLSDIIEKETGKOLVIQESILMLPEEVEEVIGNKP

-continued

ESDILVHTAYDESTDENVMLLTSDAPEYKPWALVIQDSNGENKIKMLSGGSKRTADGSEFEPKK

KRKV

G1333 DddA$_{tox}$-C-dSpCas9-2x-*UGI*

(SEQ ID NO: 293)

AAACGGACAGCCGACGGAAGCGAGTTCGAGTCACCAAAGAAGAAGCGGAAAGTCCCAACCCCGT

ACCCAAACTATGCCAATGCCGGTCATGTGGAGGGTCAGAGCGCCCTGTTCATGCGTGATAACGG

CATCAGCGAGGGTCTGGTGTTCCACAACAACCCGGAAGGCACCTGCGGTTTTTGCGTGAACATG

ACCGAGACCCTGCTGCCGGAAAACGCGAAAATGACCGTGGTGCCGCCGGAAGGTGCCATTCCAG

TGAAGCGCGGCGCTACCGGTGAAACCAAAGTGTTTACCGGTAACAGCAACAGCCCGAAGAGCCC

GACCAAAGGCGGTTGCTTCTGGAGGATCTAGCGGAGGATCCTCTGGCAGCGAGACACCAGGAAC

AAGCGAGTCAGCAACACCAGAGAGCAGTGGCGGCAGCAGCGGCGGCAGCGACAAGAAGTACAGC

ATCGGCCTGGCCATCGGCACCAACTCTGTGGGCTGGGCCGTGATCACCGACGAGTACAAGGTGC

CCAGCAAGAAATTCAAGGTGCTGGGCAACACCGACCGGCACAGCATCAAGAAGAACCTGATCGG

AGCCCTGCTGTTCGACAGCGGCGAAACAGCCGAGGCCACCCGGCTGAAGAGAACCGCCAGAAGA

AGATACACCAGACGGAAGAACCGGATCTGCTATCTGCAAGAGATCTTCAGCAACGAGATGGCCA

AGGTGGACGACAGCTTCTTCCACAGACTGGAAGAGTCCTTCCTGGTGGAAGAGGATAAGAAGCA

CGAGCGGCACCCCATCTTCGGCAACATCGTGGACGAGGTGGCCTACCACGAGAAGTACCCCACC

ATCTACCACCTGAGAAAGAAACTGGTGGACAGCACCGACAAGGCCGACCTGCGGCTGATCTATC

TGGCCCTGGCCCACATGATCAAGTTCCGGGGCCACTTCCTGATCGAGGGCGACCTGAACCCCGA

CAACAGCGACGTGGACAAGCTGTTCATCCAGCTGGTGCAGACCTACAACCAGCTGTTCGAGGAA

AACCCCATCAACGCCAGCGGCGTGGACGCCAAGGCCATCCTGTCTGCCAGACTGAGCAAGAGCA

GACGGCTGGAAAATCTGATCGCCCAGCTGCCCGGCGAGAAGAAGAATGGCCTGTTCGGAAACCT

GATTGCCCTGAGCCTGGGCCTGACCCCCAACTTCAAGAGCAACTTCGACCTGGCCGAGGATGCC

AAACTGCAGCTGAGCAAGGACACCTACGACGACGACCTGGACAACCTGCTGGCCCAGATCGGCG

ACCAGTACGCCGACCTGTTTCTGGCCGCCAAGAACCTGTCCGACGCCATCCTGCTGAGCGACAT

CCTGAGAGTGAACACCGAGATCACCAAGGCCCCCCTGAGCGCCTCTATGATCAAGAGATACGAC

GAGCACCACCAGGACCTGACCCTGCTGAAAGCTCTCGTGCGGCAGCAGCTGCCTGAGAAGTACA

AAGAGATTTTCTTCGACCAGAGCAAGAACGGCTACGCCGGCTACATTGACGGCGGAGCCAGCCA

GGAAGAGTTCTACAAGTTCATCAAGCCCATCCTGGAAAAGATGGACGGCACCGAGGAACTGCTC

GTGAAGCTGAACAGAGAGGACCTGCTGCGGAAGCAGCGGACCTTCGACAACGGCAGCATCCCCC

ACCAGATCCACCTGGGAGAGCTGCACGCCATTCTGCGGCGGCAGGAAGATTTTTACCCATTCCT

GAAGGACAACCGGGAAAAGATCGAGAAGATCCTGACCTTCCGCATCCCCTACTACGTGGGCCCT

CTGGCCAGGGGAAACAGCAGATTCGCCTGGATGACCAGAAAGAGCGAGGAAACCATCACCCCCT

GGAACTTCGAGGAAGTGGTGGACAAGGGCGCTTCCGCCCAGAGCTTCATCGAGCGGATGACCAA

CTTCGATAAGAACCTGCCCAACGAGAAGGTGCTGCCCAAGCACAGCCTGCTGTACGAGTACTTC

ACCGTGTATAACGAGCTGACCAAAGTGAAATACGTGACCGAGGGAATGAGAAAGCCCGCCTTCC

TGAGCGGCGAGCAGAAAAAGGCCATCGTGGACCTGCTGTTCAAGACCAACCGGAAAGTGACCGT

GAAGCAGCTGAAAGAGGACTACTTCAAGAAAATCGAGTGCTTCGACTCCGTGGAAATCTCCGGC

GTGGAAGATCGGTTCAACGCCTCCCTGGGCACATACCACGATCTGCTGAAAATTATCAAGGACA

AGGACTTCCTGGACAATGAGGAAAACGAGGACATTCTGGAAGATATCGTGCTGACCCTGACACT

-continued

GTTTGAGGACAGAGAGATGATCGAGGAACGGCTGAAAACCTATGCCCACCTGTTCGACGACAAA

GTGATGAAGCAGCTGAAGCGGCGGAGATACACCGGCTGGGGCAGGCTGAGCCGGAAGCTGATCA

ACGGCATCCGGGACAAGCAGTCCGGCAAGACAATCCTGGATTTCCTGAAGTCCGACGGCTTCGC

CAACAGAAACTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCCGGCAGCCCCG

CCATTAAGAAGGGCATCCTGCAGACAGTGAAGGTGGTGGACGAGCTCGTGAAAGTGATGGGCCG

GCACAAGCCCGAGAACATCGTGATCGAAATGGCCAGAGAGAACCAGACCACCCAGAAGGGACAG

AAGAACAGCCGCGAGAGAATGAAGCGGATCGAAGAGGGCATCAAAGAGCTGGGCAGCCAGATCC

TGAAAGAACACCCCGTGGAAAACACCCAGCTGCAGAACGAGAAGCTGTACCTGTACTACCTGCA

GAATGGGCGGGATATGTACGTGGACCAGGAACTGGACATCAACCGGCTGTCCGACTACGATGTG

GACGCTATCGTGCCTCAGAGCTTTCTGAAGGACGACTCCATCGACAACAAGGTGCTGACCAGAA

GCGACAAGAACCGGGGCAAGAGCGACAACGTGCCCTCCGAAGAGGTCGTGAAGAAGATGAAGAA

CTACTGGCGGCAGCTGCTGAACGCCAAGCTGATTACCCAGAGAAAGTTCGACAATCTGACCAAG

GCCGAGAGAGGCGGCCTGAGCGAACTGGATAAGGCCGGCTTCATCAAGAGACAGCTGGTGGAAA

CCCGGCAGATCACAAAGCACGTGGCACAGATCCTGGACTCCCGGATGAACACTAAGTACGACGA

GAATGACAAGCTGATCCGGGAAGTGAAAGTGATCACCCTGAAGTCCAAGCTGGTGTCCGATTTC

CGGAAGGATTTCCAGTTTTACAAAGTGCGCGAGATCAACAACTACCACCACGCCCACGACGCCT

ACCTGAACGCCGTCGTGGGAACCGCCCTGATCAAAAAGTACCCTAAGCTGGAAAGCGAGTTCGT

GTACGGCGACTACAAGGTGTACGACGTGCGGAAGATGATCGCCAAGAGCGAGCAGGAAATCGGC

AAGGCTACCGCCAAGTACTTCTTCTACAGCAACATCATGAACTTTTTCAAGACCGAGATTACCC

TGGCCAACGGCGAGATCCGGAAGCGGCCTCTGATCGAGACAAACGGCGAAACCGGGGAGATCGT

GTGGGATAAGGGCCGGGATTTTGCCACCGTGCGGAAAGTGCTGAGCATGCCCCAAGTGAATATC

GTGAAAAAGACCGAGGTGCAGACAGGCGGCTTCAGCAAAGAGTCTATCCTGCCCAAGAGGAACA

GCGATAAGCTGATCGCCAGAAAGAAGGACTGGGACCCTAAGAAGTACGGCGGCTTCGACAGCCC

CACCGTGGCCTATTCTGTGCTGGTGGTGGCCAAAGTGGAAAAGGGCAAGTCCAAGAAACTGAAG

AGTGTGAAAGAGCTGCTGGGGATCACCATCATGGAAAGAAGCAGCTTCGAGAAGAATCCCATCG

ACTTTCTGGAAGCCAAGGGCTACAAAGAAGTGAAAAAGGACCTGATCATCAAGCTGCCTAAGTA

CTCCCTGTTCGAGCTGGAAAACGGCCGGAAGAGAATGCTGGCCTCTGCCGGCGAACTGCAGAAG

GGAAACGAACTGGCCCTGCCCTCCAAATATGTGAACTTCCTGTACCTGGCCAGCCACTATGAGA

AGCTGAAGGGCTCCCCCGAGGATAATGAGCAGAAACAGCTGTTTGTGGAACAGCACAAGCACTA

CCTGGACGAGATCATCGAGCAGATCAGCGAGTTCTCCAAGAGAGTGATCCTGGCCGACGCTAAT

CTGGACAAAGTGCTGTCCGCCTACAACAAGCACCGGGATAAGCCCATCAGAGAGCAGGCCGAGA

ATATCATCCACCTGTTTACCCTGACCAATCTGGGAGCCCCTGCCGCCTTCAAGTACTTTGACAC

CACCATCGACCGGAAGAGGTACACCAGCACCAAAGAGGTGCTGGACGCCACCCTGATCCACCAG

AGCATCACCGGCCTGTACGAGACACGGATCGACCTGTCTCAGCTGGGAGGTGACAGCGGCGGGA

GCGGCGGGAGCGGGGGGAGCACTAATCTGAGCGACATCATTGAGAAGGAGACTGGGAAACAGCT

GGTCATTCAGGAGTCCATCCTGATGCTGCCTGAGGAGGTGGAGGAAGTGATCGGCAACAAGCCA

GAGTCTGACATCCTGGTGCACACCGCCTACGACGAGTCCACAGATGAGAATGTGATGCTGCTGA

-continued

CCTCTGACGCCCCCGAGTATAAGCCTTGGGCCCTGGTCATCCAGGATTCTAACGGCGAGAATAA

GATCAAGATGCTGAGCGGAGGATCCGGAGGATCTGGAGGCAGCACCAACCTGTCTGACATCATC

GAGAAGGAGACAGGCAAGCAGCTGGTCATCCAGGAGAGCATCCTGATGCTGCCCGAAGAAGTCG

AAGAAGTGATCGGAAACAAGCCTGAGAGCGATATCCTGGTCCATACCGCCTACGACGAGAGTAC

CGACGAAAATGTGATGCTGCTGACATCCGACGCCCCAGAGTATAAGCCCTGGGCTCTGGTCATC

CAGGATTCCAACGGAGAGAACAAAATCAAAATGCTGTCTGGCGGCTCAAAAAGAACCGCCGACG

GCAGCGAATTCGAGCCCAAGAAGAAGAGGAAAGTC

Split-DddA$_{tox}$-CCR5 TALE Fusions Sequences

*CCR5 Left*-*G1333-DddA$_{tox}$-N*-*1xUGI*

(SEQ ID NO: 294)

CCCAAGAAGAAGAGGAAGGTGGGCATTCACCGCGGGGTACCTATGGTGGACTTGAGGACACTCG

GTTATTCGCAACAGCAACAGGAGAAAATCAAGCCTAAGGTCAGGAGCACCGTCGCGCAACACCA

CGAGGCGCTTGTGGGGCATGGCTTCACTCATGCGCATATTGTCGCGCTTTCACAGCACCCTGCG

GCGCTTGGGACGGTGGCTGTCAAATACCAAGATATGATTGCGGCCCTGCCCGAAGCCACGCACG

AGGCAATTGTAGGGGTCGGTAAACAGTGGTCGGGAGCGCGAGCACTTGAGGCGCTGCTGACTGT

GGCGGGTGAGCTTAGGGGGCCTCCGCTCCAGCTCGACACCGGGCAGCTGCTGAAGATCGCGAAG

AGAGGGGGAGTAACAGCGGTAGAGGCAGTGCACGCCTGGCGCAATGCGCTCACCGGGGCCCCCT

TGAACCTGACCCCAGACCAGGTAGTCGCAATCGCGTCAAACGGAGGGGGAAAGCAAGCCCTGGA

AACCGTGCAAAGGTTGTTGCCGGTCCTTTGTCAAGACCACGGCCTTACACCGGAGCAAGTCGTG

GCCATTGCATCCCACGACGGTGGCAAACAGGCTCTTGAGACGGTTCAGAGACTTCTCCCAGTTC

TCTGTCAAGCCCACGGGCTGACTCCCGATCAAGTTGTAGCGATTGCGTCGAACATTGGAGGGAA

ACAAGCATTGGAGACTGTCCAACGGCTCCTTCCCGTGTTGTGTCAAGCCCACGGTTTGACGCCT

GCACAAGTGGTCGCCATCGCCTCGAATGGCGGCGGTAAGCAGGCGCTGGAAACAGTACAGCGCC

TGCTGCCTGTACTGTGCCAGGATCATGGACTGACCCCAGACCAGGTAGTCGCAATCGCGTCAAA

CGGAGGGGGAAAGCAAGCCCTGGAAACCGTGCAAAGGTTGTTGCCGGTCCTTTGTCAAGACCAC

GGCCTTACACCGGAGCAAGTCGTGGCCATTGCAAGCAACATCGGTGGCAAACAGGCTCTTGAGA

CGGTTCAGAGACTTCTCCCAGTTCTCTGTCAAGCCCACGGGCTGACTCCCGATCAAGTTGTAGC

GATTGCGTCGCATGACGGAGGGAAACAAGCATTGGAGACTGTCCAACGGCTCCTTCCCGTGTTG

TGTCAAGCCCACGGTTTGACGCCTGCACAAGTGGTCGCCATCGCCTCCAATATTGGCGGTAAGC

AGGCGCTGGAAACAGTACAGCGCCTGCTGCCTGTACTGTGCCAGGATCATGGACTGACCCCAGA

CCAGGTAGTCGCAATCGCGTCACATGACGGGGGAAAGCAAGCCCTGGAAACCGTGCAAAGGTTG

TTGCCGGTCCTTTGTCAAGACCACGGCCTTACACCGGAGCAAGTCGTGGCCATTGCATCCCACG

ACGGTGGCAAACAGGCTCTTGAGACGGTTCAGAGACTTCTCCCAGTTCTCTGTCAAGCCCACGG

GCTGACTCCCGATCAAGTTGTAGCGATTGCGTCCAACGGTGGAGGGAAACAAGCATTGGAGACT

GTCCAACGGCTCCTTCCCGTGTTGTGTCAAGCCCACGGTTTGACGCCTGCACAAGTGGTCGCCA

TCGCCAACAACAACGGCGGTAAGCAGGCGCTGGAAACAGTACAGCGCCTGCTGCCTGTACTGTG

CCAGGATCATGGACTGACCCCAGACCAGGTAGTCGCAATCGCGTCACATGACGGGGGAAAGCAA

-continued

GCCCTGGAAACCGTGCAAAGGTTGTTGCCGGTCCTTTGTCAAGACCACGGCCTTACACCGGAGC

AAGTCGTGGCCATTGCAAGCAACATCGGTGGCAAACAGGCTCTTGAGACGGTTCAGAGACTTCT

CCCAGTTCTCTGTCAAGCCCACGGGCTGACTCCCGATCAAGTTGTAGCGATTGCGAATAACAAT

GGAGGGAAACAAGCATTGGAGACTGTCCAACGGCTCCTTCCCGTGTTGTGTCAAGCCCACGGTT

TGACGCCTGCACAAGTGGTCGCCATCGCCAGCCATGATGGCGGTAAGCAGGCGCTGGAAACAGT

ACAGCGCCTGCTGCCTGTACTGTGCCAGGATCATGGACTGACACCCGAACAGGTGGTCGCCATT

GCTTCTAATGGGGGAGGACGGCCAGCCTTGGAGTCCATCGTAGCCCAATTGTCCAGGCCCGATC

CCGCGTTGGCTGCGTTAACGAATGACCATCTGGTGGCGTTGGCATGTCTTGGTGGACGACCCGC

GCTCGATGCAGTCAAAAAGGGTCTGCCTCATGCTCCCGCATTGATCAAAAGAACCAACCGGCGG

ATTCCCGAGAGAACTTCCCATCGAGTCGCGGGATCCGGCAGCTACGCCCTGGGTCCGTATCAGA

TTAGCGCCCCGCAGCTGCCAGCTTACAATGGTCAGACCGTGGGTACCTTCTACTATGTGAACGA

CGCGGGCGGTCTGGAGAGCAAGGTGTTTAGCAGCGGCGGTTCTGGCGGCTCAACTAATCTGAGC

GACATCATTGAGAAGGAGACTGGGAAACAGCTGGTCATTCAGGAGTCCATCCTGATGCTGCCTG

AGGAGGTGGAGGAAGTGATCGGCAACAAGCCAGAGTCTGACATCCTGGTGCACACCGCCTACGA

CGAGTCCACAGATGAGAATGTGATGCTGCTGACCTCTGACGCCCCCGAGTATAAGCCTTGGGCC

CTGGTCATCCAGGATTCTAACGGCGAGAATAAGATCAAGATGCTG

Tranlated amino acid sequence:

(SEQ ID NO: 295)

PKKKRKVGIHRGVPMVDLRTLGYSQQQQEKIKPKVRSTVAQHHEALVGHGFTHAHIVALSQHPA

ALGTVAVKYQDMIAALPEATHEAIVGVGKOWSGARALEALLTVAGELRGPPLOLDTGQLLKIAK

RGGVTAVEAVHAWRNALTGAPLNLTPDQVVAIASNGGGKQALETVORLLPVLCQDHGLTPEQVV

AIASHDGGKQALETVQRLLPVLCQAHGLTPDQVVAIASNIGGKQALETVORLLPVLCQAHGLTP

AQVVAIASNGGGKQALETVORLLPVLCQDHGLTPDQVVAIASNGGGKQALETVORLLPVLCQDH

GLTPEQVVAIASNIGGKQALETVORLLPVLCQAHGLTPDQVVAIASHDGGKQALETVQRLLPVL

CQAHGLTPAQVVAIASNIGGKQALETVORLLPVLCQDHGLTPDQVVAIASHDGGKQALETVORL

LPVLCQDHGLTPEQVVAIASHDGGKQALETVORLLPVLCQAHGLTPDQVVAIASNGGGKQALET

VQRLLPVLCQAHGLTPAQVVAIANNNGGKQALETVORLLPVLCQDHGLTPDQVVAIASHDGGKQ

ALETVQRLLPVLCQDHGLTPEQVVAIASNIGGKQALETVQRLLPVLCQAHGLTPDQVVAIANNN

GGKQALETVORLLPVLCQAHGLTPAQVVAIASHDGGKQALETVORLLPVLCQDHGLTPEQVVAI

ASNGGGRPALESIVAQLSRPDPALAALTNDHLVALACLGGRPALDAVKKGLPHAPALIKRTNRR

IPERTSHRVAGSGSYALGPYQISAPOLPAYNGQTVGTFYYVNDAGGLESKVFSSGGSGGSTNLS

DIIEKETGKQLVIQESILMLPEEVEEVIGNKPESDILVHTAYDESTDENVMLLTSDAPEYKPWA

LVIQDSNGENKIKML

*CCR5 Right*-***G1333*-*DddA$_{tox}$*-*N***-*1xUGI*

(SEQ ID NO: 296)

CCCAAGAAGAAGAGGAAGGTGGGCATTCACCGCGGGGTACCTATGGTGGACTTGAGGACACTCG

GTTATTCGCAACAGCAACAGGAGAAAATCAAGCCTAAGGTCAGGAGCACCGTCGCGCAACACCA

CGAGGCGCTTGTGGGGCATGGCTTCACTCATGCGCATATTGTCGCGCTTTCACAGCACCCTGCG

GCGCTTGGGACGGTGGCTGTCAAATACCAAGATATGATTGCGGCCCTGCCCGAAGCCACGCACG

AGGCAATTGTAGGGGTCGGTAAACAGTGGTCGGGAGCGCGAGCACTTGAGGCGCTGCTGACTGT

GGCGGGTGAGCTTAGGGGGCCTCCGCTCCAGCTCGACACCGGGCAGCTGCTGAAGATCGCGAAG

AGAGGGGGAGTAACAGCGGTAGAGGCAGTGCACGCCTGGCGCAATGCGCTCACCGGGGCCCCCT

TGAACCTGACCCCAGACCAGGTAGTCGCAATCGCGTCACATGACGGGGGAAAGCAAGCCCTGGA

-continued

AACCGTGCAAAGGTTGTTGCCGGTCCTTTGTCAAGACCACGGCCTTACACCGGAGCAAGTCGTG
GCCATTGCAAGCAATGGGGGTGGCAAACAGGCTCTTGAGACGGTTCAGAGACTTCTCCCAGTTC
TCTGTCAAGCCCACGGGCTGACTCCCGATCAAGTTGTAGCGATTGCGTCCAACGGTGGAGGGAA
ACAAGCATTGGAGACTGTCCAACGGCTCCTTCCCGTGTTGTGTCAAGCCCACGGTTTGACGCCT
GCACAAGTGGTCGCCATCGCCAGCCATGATGGCGGTAAGCAGGCGCTGGAAACAGTACAGCGCC
TGCTGCCTGTACTGTGCCAGGATCATGGACTGACCCCAGACCAGGTAGTCGCAATCGCGTCACA
TGACGGGGGAAAGCAAGCCCTGGAAACCGTGCAAAGGTTGTTGCCGGTCCTTTGTCAAGACCAC
GGCCTTACACCGGAGCAAGTCGTGGCCATTGCAAGCAACATCGGTGGCAAACAGGCTCTTGAGA
CGGTTCAGAGACTTCTCCCAGTTCTCTGTCAAGCCCACGGGCTGACTCCCGATCAAGTTGTAGC
GATTGCGAATAACAATGGAGGGAAACAAGCATTGGAGACTGTCCAACGGCTCCTTCCCGTGTTG
TGTCAAGCCCACGGTTTGACGCCTGCACAAGTGGTCGCCATCGCCTCCAATATTGGCGGTAAGC
AGGCGCTGGAAACAGTACAGCGCCTGCTGCCTGTACTGTGCCAGGATCATGGACTGACCCCAGA
CCAGGTAGTCGCAATCGCGTCGAACATTGGGGGAAAGCAAGCCCTGGAAACCGTGCAAAGGTTG
TTGCCGGTCCTTTGTCAAGACCACGGCCTTACACCGGAGCAAGTCGTGGCCATTGCAAGCAATG
GGGGTGGCAAACAGGCTCTTGAGACGGTTCAGAGACTTCTCCCAGTTCTCTGTCAAGCCCACGG
GCTGACTCCCGATCAAGTTGTAGCGATTGCGTCCAACGGTGGAGGGAAACAAGCATTGGAGACT
GTCCAACGGCTCCTTCCCGTGTTGTGTCAAGCCCACGGTTTGACGCCTGCACAAGTGGTCGCCA
TCGCCAACAACAACGGCGGTAAGCAGGCGCTGGAAACAGTACAGCGCCTGCTGCCTGTACTGTG
CCAGGATCATGGACTGACCCCAGACCAGGTAGTCGCAATCGCGTCGAACATTGGGGGAAAGCAA
GCCCTGGAAACCGTGCAAAGGTTGTTGCCGGTCCTTTGTCAAGACCACGGCCTTACACCGGAGC
AAGTCGTGGCCATTGCAAGCAATGGGGGTGGCAAACAGGCTCTTGAGACGGTTCAGAGACTTCT
CCCAGTTCTCTGTCAAGCCCACGGGCTGACTCCCGATCAAGTTGTAGCGATTGCGTCGAACATT
GGAGGGAAACAAGCATTGGAGACTGTCCAACGGCTCCTTCCCGTGTTGTGTCAAGCCCACGGTT
TGACGCCTGCACAAGTGGTCGCCATCGCCAGCCATGATGGCGGTAAGCAGGCGCTGGAAACAGT
ACAGCGCCTGCTGCCTGTACTGTGCCAGGATCATGGACTGACACCCGAACAGGTGGTCGCCATT
GCTTCTAATGGGGGAGGACGGCCAGCCTTGGAGTCCATCGTAGCCCAATTGTCCAGGCCCGATC
CCGCGTTGGCTGCGTTAACGAATGACCATCTGGTGGCGTTGGCATGTCTTGGTGGACGACCCGC
GCTCGATGCAGTCAAAAAGGGTCTGCCTCATGCTCCCGCATTGATCAAAAGAACCAACCGGCGG
ATTCCCGAGAGAACTTCCCATCGAGTCGCGGGATCCCCAACCCCGTACCCAAACTATGCCAATG
CCGGTCATGTGGAGGGTCAGAGCGCCCTGTTCATGCGTGATAACGGCATCAGCGAGGGTCTGGT
GTTCCACAACAACCCGGAAGGCACCTGCGGTTTTTGCGTGAACATGACCGAGACCCTGCTGCCG
GAAAACGCGAAAATGACCGTGGTGCCGCCGGAAGGTGCCATTCCAGTGAAGCGCGGCGCTACCG
GTGAAACCAAAGTGTTTACCGGTAACAGCAACAGCCCGAAGAGCCCGACCAAAGGCGGTTGCTC
TGGCGGCTCAACTAATCTGAGCGACATCATTGAGAAGGAGACTGGGAAACAGCTGGTCATTCAG
GAGTCCATCCTGATGCTGCCTGAGGAGGTGGAGGAAGTGATCGGCAACAAGCCAGAGTCTGACA
TCCTGGTGCACACCGCCTACGACGAGTCCACAGATGAGAATGTGATGCTGCTGACCTCTGACGC
CCCCGAGTATAAGCCTTGGGCCCTGGTCATCCAGGATTCTAACGGCGAGAATAAGATCAAGATG
CTG

-continued

Translated amino acid sequence:

(SEQ ID NO: 297)

PKKKRKVGIHRGVPMVDLRTLGYSQQQQEKIKPKVRSTVAQHHEALVGHGFTHAHIVALSQHPA

ALGTVAVKYQDMIAALPEATHEAIVGVGKOWSGARALEALLTVAGELRGPPLOLDTGQLLKIAK

RGGVTAVEAVHAWRNALTGAPLNLTPDQVVAIASHDGGKQALETVORLLPVLCQDHGLTPEQVV

AIASNGGGKQALETVQRLLPVLCQAHGLTPDQVVAIASNGGGKQALETVORLLPVLCQAHGLTP

AQVVAIASHDGGKQALETVQRLLPVLCQDHGLTPDQVVAIASHDGGKOALETVQRLLPVLCQDH

GLTPEQVVAIASNIGGKQALETVORLLPVLCQAHGLTPDQVVAIANNNGGKQALETVORLLPVL

CQAHGLTPAQVVAIASNIGGKQALETVQRLLPVLCQDHGLTPDQVVAIASNIGGKQALETVQRL

LPVLCQDHGLTPEQVVAIASNGGGKQALETVQRLLPVLCQAHGLTPDQVVAIASNGGGKQALET

VQRLLPVLCQAHGLTPAQVVAIANNNGGKQALETVORLLPVLCQDHGLTPDQVVAIASNIGGKQ

ALETVQRLLPVLCQDHGLTPEQVVAIASNGGGKQALETVORLLPVLCQAHGLTPDQVVAIASNI

GGKQALETVORLLPVLCQAHGLTPAQVVAIASHDGGKQALETVQRLLPVLCQDHGLTPEQVVAI

ASNGGGRPALESIVAQLSRPDPALAALTNDHLVALACLGGRPALDAVKKGLPHAPALIKRINRR

IPERTSHRVAGSPTPYPNYANAGHVEGQSALFMRDNGISEGLVFHNNPEGTCGFCVNMTETLLP

ENAKMTVVPPEGAIPVKRGATGETKVFTGNSNSPKSPTKGGCSGGSTNLSDIIEKETGKOLVIQ

ESILMLPEEVEEVIGNKPESDILVHTAYDESTDENVMLLTSDAPEYKPWALVIQDSNGENKIKM

L

General DdCBE Architecture and mitoTALE Sequences
Legend:

| | |
|---|---|
| *COX8A* MTS | *COX8A* MTS (Right)—Underlined |
| *SOD2* MTS | ***SOD2* MTS (Left)—Bolded** |
| 3xFLAG | 3xFLAG (Right)—Dashed Underlined |
| 3xHA | *3xHA (Left)*—Italicized and Underlined |
| mitoTALE | **mitoTALE**—Bolded and Heavy Underlined |
| DddA$_{tox}$ half | ***DddA$_{tox}$ half***—Bolded, Italicized, and Underlined |
| 1x-UGI1x-UGI | 1x-UGI—Thick Dashed Underlined |
| ATP5B 3'UTR | *ATP5B* 3'UTR (Right)—Dotted Underlined |
| SOD2 3'UTR | *SOD2* 3'UTR (Left)—Double Underlined |

All right-side halves of DdCBEs have the general architecture of (from N- to C-terminus): COX8A MTS-3xFLAG-mitoTALE-2aa linker-DddA$_{tox}$ half-4aa linker-1x-UGI-ATPSB 3'UTR All left-side halves of DdCBEs have the general architecture of (from N- to C-terminus): SOD2 MTS-3xHA-mitoTALE-2aa linker-DddA$_{tox}$ half-4aa linker-1x-UGI-SOD2 3'UTR

*SOD2* MTS-3xHA-mitoTALE-2aa linker-DddA$_{tox}$ half-4aa linker-1x-UGI- *SOD2* 3'UTR (*A*) *SOD2 MTS*

(SEQ ID NO: 298)

MLSRAVCGTSRQLAPVLGYLGSROKHSLPD (*B*) *COX8A MTS*

(SEQ ID NO: 299)

MSVLTPLLLRGLTGSARRLPVPRAKIHSL (*C*) *SOD2 3'UTR*

(SEQ ID NO: 300)

ACCACGATCGTTATGCTGATCATACCCTAATGATCCCAGCAAGATAATGTCCTGTCTTCTAAGA

TGTGCATCAAGCCTGGTACATACTGAAAACCCTATAAGGTCCTGGATAATTTTTGTTTGATTAT

-continued

TCATTGAAGAAACATTTATTTTCCAATTGTGTGAAGTTTTTGACTGTTAATAAAAGAATCTGTC

AACCATCAAAAAAAAAAAAAAA (*D*) *ATP5B 3'UTR*

(SEQ ID NO: 301)

ACCACGATCGTTATGCTGATCATACCCTAATGATCCCAGCAAGATAATGTCCTGTCTTCTAAGA

TGTGCATCAAGCCTGGTACATACTGAAAACCCTATAAGGTCCTGGATAATTTTTGTTTGATTAT

TCATTGAAGAAACATTTATTTTCCAATTGTGTGAAGTTTTTGACTGTTAATAAAAGAATCTGTC

AACCATCAAAAAAAAAAAAAAA (*E*) *ND6-DdCBE: Left mitoTALE-G1397-DddAtox-N-1x-UGI*

(SEQ ID No: 302)

ATGGCCCTGTCCCGTGCGGTTTGTGGCACCTCCCGTCAACTGGCTCCGGTTCTGGGTTATCTGG

GTTCCCGTCAAAAACACTCCCTGCCGGAC<u>*TACCCGTATGATGTTCCGGATTACGCTGGCTACCC*</u>

<u>*ATACGACGTCCCAGACTACGCTGGCTACCCATACGACGTCCCAGACTACGCT*ATGGACATCGCG</u>

<u>GATCTGCGTACCCTGGGTTACAGCCAGCAGCAGCAGGAGAAGATCAAGCCGAAGGTGCGCAGCA</u>

<u>CCGTGGCTCAGCACCACGAAGCCCTGGTGGGCCACGGTTTCACCCACGCTCACATTGTGGCCCT</u>

<u>GAGCCAGCACCCAGCCGCGCTGGGCACCGTGGCCGTGAAATATCAGGATATGATTGCTGCCCTG</u>

<u>CCAGAGGCCACCCATGAAGCTATTGTGGGCGTGGGCAAGCAGTGGAGCGGTGCTCGTGCGCTGG</u>

<u>AGGCGCTGCTGACCGTGGCTGGTGAACTGCGTGGTCCGCCGCTGCAGCTGGACACCGGTCAGCT</u>

<u>GCTGAAAATCGCGAAACGTGGCGGTGTGACCGCGGTGGAAGCCGTGCATGCTTGGCGTAATGCT</u>

<u>CTGACCGGTGCGCCGCTGAACCTGACCCCGCAGCAGGTGGTGGCTATTGCCAGCAACAACGGCG</u>

<u>GTAAACAGGCCCTGGAGACCGTGCAGCGCCTGCTGCCGGTGCTGTGCCAGGCCCATGGTCTGAC</u>

<u>CCCGGAGCAGGTGGTGGCGATCGCTAGCAACATCGGCGGCAAGCAGGCCCTGGAAACCGTGCAG</u>

<u>GCGCTGTTACCGGTGCTGTGCCAGGCTCATGGCCTGACCCCGGAACAAGTTGTGGCTATTGCCA</u>

<u>GCCATGATGGCGGTAAACAGGCTCTGGAAACCGTGCAGCGTCTGTTGCCGGTGCTGTGCCAAGC</u>

<u>CCATGGCCTGACCCCGGAGCAAGTTGTGGCTATTGCGAGCCATGATGGCGGCAAGCAGGCGCTG</u>

<u>GAAACCGTTCAGCGCCTGTTACCGGTGCTGTGCCAAGCTCATGGTCTGACCCCGGAACAGGTGG</u>

<u>TGGCCATTGCTTCCCATGATGGCGGTAAACAGGCCCTGGAAACCGTTCAGCGTCTGCTTCCGGT</u>

<u>GCTGTGCCAGGCCCATGGGCTGACCCCGGAACAAGTGGTTGCTATTGCCAGCCACGATGGCGGC</u>

<u>AAGCAGGCTCTGGAGACCGTTCAGCGCCTGCTTCCGGTGCTGTGCCAGGCCCATGGCTTAACCC</u>

<u>CGGAACAAGTTGTTGCTATTGCTAGTCATGATGGCGGTAAACAGGCGCTGGAGACCGTTCAGCG</u>

<u>TCTGTTACCGGTGCTGTGCCAGGCGCATGGCTTAACCCCGGAGCAGGTTGTTGCCATTGCCTCC</u>

<u>AATATCGGCGGCAAGCAGGCTCTGGAAACCGTTCAGGCCCTGTTGCCGGTGCTGTGCCAGGCCC</u>

<u>ATGGACTGACCCCGCAGCAAGTTGTTGCCATTGCCAGCAATGGCGGTGGCAAACAGGCGCTGGA</u>

<u>AACTGTTCAGCGCCTGCTCCCGGTGCTGTGCCAAGCGCATGGTCTGACCCCGCAGCAAGTGGTT</u>

<u>GCTATTGCTAGCAATGGTGGCGGTCGTCCGGCGCTGGAAAGCATTGTGGCTCAGCTGAGCCGTC</u>

<u>CAGACCCGGCCCTGGCGGCTCTGACCAACGATCACCTGGTGGCGCTGGCTTGCCTGGGCGGTCG</u>

<u>TCCGGCCCTGGATGCGGTGAAGAAAGGCCTGGGT</u>GGATCC<u>*GGCAGCTACGCCCTGGGTCCGTAT*</u>

<u>*CAGATTAGCGCCCCGCAGCTGCCAGCTTACAATGGTCAGACCGTGGGTACCTTCTACTATGTGA*</u>

<u>*ACGACGCGGGCGGTCTGGAGAGCAAGGTGTTTAGCAGCGGCGGTCCAACCCCGTACCCAAACTA*</u>

<u>*TGCCAATGCCGGTCATGTGGAGGGTCAGAGCGCCCTGTTCATGCGTGATAACGGCATCAGCGAG*</u>

<u>*GGTCTGGTGTTCCACAACAACCCGGAAGGCACCTGCGGT*</u>TTTTGCGTGAACATGACCGAGACCC

TGCTGCCGGAAAACGCGAAAATGACCGTGGTGCCGCCGGAAGGTTCTGGCGGCTCAACTAATCT

-continued

GAGCGACATCATTGAGAAGGAGACTGGGAAACAGCTGGTCATTCAGGAGTCCATCCTGATGCTG

CCTGAGGAGGTGGAGGAAGTGATCGGCAACAAGCCAGAGTCTGACATCCTGGTGCACACCGCCT

ACGACGAGTCCACAGATGAGAATGTGATGCTGCTGACCTCTGACGCCCCCGAGTATAAGCCTTG

GGCCCTGGTCATCCAGGATTCTAACGGCGAGAATAAGATCAAGATGCTGTGATAAACCACGATC

GTTATGCTGATCATACCCTAATGATCCCAGCAAGATAATGTCCTGTCTTCTAAGATGTGCATCA

AGCCTGGTACATACTGAAAACCCTATAAGGTCCTGGATAATTTTTGTTTGATTATTCATTGAAG

AAACATTTATTTTCCAATTGTGTGAAGTTTTTGACTGTTAATAAAAGAATCTGTCAACCATCAA

A

*(F) ND6-DdCBE: Right mitoTALE-G1397-DddAtox-N-1x-UGI*

(SEQ ID NO: 303)

TCCGTTCTGACCCCGCTGCTGCTGCGTGGCCTGACCGGCTCCGCTCGTCGTCTGCCAGTTCCGC

GTGCGAAAATCCATTCCCTGGACTACAAAGACCATGACGGTGATTATAAAGATCATGACATCGA

TTACAAGGATGACGATGACAAGATGGACATCGCGGATCTGCGTACCCTGGGTTACAGCCAGCAG

CAGCAGGAGAAGATCAAGCCAAAGGTGCGCAGCACCGTGGCCCAGCACCATGAAGCTCTGGTGG

GTCACGGCTTCACCCACGCGCACATCGTGGCTCTGAGCCAGCACCCAGCCGCGCTGGGTACCGT

GGCCGTGAAATATCAGGACATGATTGCTGCCCTGCCAGAGGCTACCCATGAAGCGATTGTGGGT

GTGGGCAAGAGAGGAGCCGGTGCTCGTGCGCTGGAGGCCCTGCTGACCGTGGCCGGTGAACTGC

GTGGCCCGCCGCTGCAGCTGGATACCGGCCAGCTGCTGAAAATCGCGAAACGTGGCGGTGTGAC

CGCTGTGGAAGCTGTGCATGCCTGGCGTAATGCTCTGACCGGTGCCCCGCTGAACCTGACCCCG

CAGCAGGTGGTGGCTATTGCCAGCAACAACGGCGGTAAACAGGCTCTGGAAACCGTGCAGCGCC

TGCTGCCGGTGCTGTGCCAGGCTCATGGTCTGACCCCGGAGCAGGTGGTGGCGATCGCTAGCAA

CATCGGCGGCAAGCAGGCTCTGGAGACCGTTCAGGCCCTGTTACCGGTGCTGTGCCAAGCCCAT

GGTCTGACCCCGCAGCAAGTTGTGGCTATTGCCAGCAATGGCGGTGGCAAACAGGCGCTGGAGA

CCGTGCAGCGTCTGTTGCCGGTGCTGTGCCAAGCCCATGGGCTGACCCCGCAGCAAGTGGTTGC

CATCGCCAGCAACAACGGTGGCAAGCAGGCCCTGGAGACCGTTCAGCGCCTGTTACCGGTGCTG

TGCCAGGCCCATGGCTTAACCCCGCAGCAAGTIGTGGCCATCGCTAGCAACAACGGTGGCAAAC

AGGCTCTGGAGACTGTTCAGCGTCTGCTTCCGGTGCTGTGCCAAGCGCATGGCCTGACCCCGGA

ACAAGTTGTTGCTATTGCCAGCCATGATGGTGGCAAGCAGGCGCTGGAAACCGTTCAGCGCCTG

CTTCCGGTGCTGTGCCAGGCGCATGGATTAACCCCGCAGCAAGTGGTGGCCATCGCCAGCAATG

GTGGCGGTAAACAGGCCCTGGAAACCGTTCAGCGTCTGTTACCGGTGCTGTGCCAGGCCCATGG

ATTAACCCCGGAACAAGTTGTGGCTATTGCGTCCAATATCGGCGGCAAGCAGGCGCTGGAAACT

GTGCAGGCTCTGCTCCCGGTGCTGTGCCAGGCCCATGGGTTAACCCCGCAGCAGGTTGTTGCCA

TTGCGAGCAACGGCGGTGGCAAACAGGCTCTGGAGACGGTTCAGCGCCTGCTCCCGGTGCTGTG

CCAGGCCCATGGTTTAACCCCGCAGCAGGTGGTTGCTATTGCTAGCAATGGCGGCGGCAAGCAG

GCGCTGGAAACGGTGCAGCGTCTGCTACCGGTGCTGTGCCAGGCACATGGCCTTACCCCGCAGC

AAGTTGTGGCCATTGCTAGCAATGGCGGTGGCCGTCCGGCCCTGGAAAGCATTGTGGCGCAGCT

GAGCCGTCCAGACCCGGCCCTGGCGGCTCTGACCAATGATCACCTGGTGGCCCTGGCCTGCCTG

GGTGGCCGTCCGGCTCTGGATGCCGTGAAGAAAGGTCTGGGCGGATCC*GCCATTCCAGTGAAGC*

*GCGGCGCTACCGGTGAAACCAAAGTGTTTACCGGTAACAGCAACAGCCCGAAGAGCCCGACCAA*

*AGGCGGTTGC*TCTGGCGGCTCAACTAATCTGAGCGACATCATTGAGAAGGAGACTGGGAAACAG

CTGGTCATTCAGGAGTCCATCCTGATGCTGCCTGAGGAGGTGGAGGAAGTGATCGGCAACAAGC

CAGAGTCTGACATCCTGGTGCACACCGCCTACGACGAGTCCACAGATGAGAATGTGATGCTGCT

-continued

GACCTCTGACGCCCCCGAGTATAAGCCTTGGGCCCTGGTCATCCAGGATTCTAACGGCGAGAAT
AAGATCAAGATGCTGTGATAAGGGGTCTTTGTCCTCTGTACTGTCTCTCTCCTTGCCCCTAACC
CAAAAAGCTTCATTTTTCTGTGTAGGCTGCACAAGAGCCTTGATTGAAGATATATTCTTTCTGA
ACAGTATTTAAGGTTTCCAATAAAATGTACACCCCTCAGAA

*(G) ND1-DdCBE Right mitoTALE repeat*

(SEQ ID NO: 304)

GACATCGCGGATCTGCGTACCCTGGGTTACAGCCAGCAGCAGCAGGAGAAGATCAAGCCAAAGG
TGCGCAGCACCGTGGCCCAGCACCATGAAGCTCTGGTGGGTCACGGCTTCACCCACGCGCACAT
CGTGGCTCTGAGCCAGCACCCAGCCGCGCTGGGTACCGTGGCCGTGAAATATCAGGACATGATT
GCTGCCCTGCCAGAGGCTACCCATGAAGCGATTGTGGGTGTGGGCAAGCAGTGGAGCGGTGCTC
GTGCGCTGGAGGCCCTGCTGACCGTGGCCGGTGAACTGCGTGGCCCGCCGCTGCAGCTGGATAC
CGGCCAGCTGCTGAAAATCGCGAAACGTGGCGGTGTGACCGCTGTGGAAGCTGTGCATGCCTGG
CGTAATGCTCTGACCGGTGCCCCGCTGAACCTGACCCCGGAACAGGTGGTTGCCATCGCATCCA
ATAATGGTGGTAAACAAGCTCTGGAGACCGTTCAAGCCCTGCTGCCAGTGCTGTGCCAGGCTCA
TGGTCTGACCCCGCAGCAAGTIGTGGCTATTGCCAGCAACATCGGCGGCAAGCAGGCCCTGGAG
ACCGTGCAGCGTCTGCTGCCGGTGCTGTGCCAGGCCCATGGCCTGACCCCGCAGCAAGTGGTTG
CTATCGCCAGCAACAACGGCGGTAAACAGGCTCTGGAAACCGTGCAGCGCCTGTTACCGGTGCT
GTGCCAAGCCCATGGTCTGACCCCGGAGCAGGTGGTGGCGATTGCTAGCAACGGCGGTGGCAAG
CAGGCTCTGGAGACCGTTCAGGCCCTGCTTCCGGTGCTGTGCCAAGCGCATGGCCTGACCCCGG
AACAAGTTGTTGCCATTGCCAGCAATGGTGGCGGTAAACAGGCGCTGGAAACCGTGCAGGCTCT
GTTACCGGTGCTGTGCCAGGCCCATGGGCTGACCCCGGAGCAAGTGGTGGCTATTGCGAGCAAT
GGCGGTGGCAAGCAGGCCCTGGAAACCGTGCAGGCGCTGTTGCCGGTGCTGTGCCAAGCCCATG
GATTAACCCCGGAACAAGTGGTGGCGATCGCTAGCAACAACGGTGGCAAACAGGCGCTGGAGAC
CGTTCAGCGTCTGTTACCGGTGCTGTGCCAGGCGCATGGCTTAACCCCGGAACAGGTTGTTGCG
ATTGCCAGCAACATTGGTGGCAAGCAGGCTCTGGAAACCGTTCAGGCCCTGCTCCCGGTGCTGT
GCCAGGCCCATGGTTTAACCCCGGAACAGGTGGTGGCCATTGCCAGCAACGGTGGCGGTAAACA
GGCCCTGGAGACCGTTCAGCGCCTGCTACCGGTGCTGTGCCAGGCCCATGGACTGACCCCGGAG
CAAGTTGTTGCCATTGCTAGCAACAACGGCGGCAAGCAGGCGCTGGAGACCGTGCAGGCTCTGC
TTCCGGTGCTGTGCCAGGCCCATGGGTTAACCCCGGAGCAGGTTGTGGCCATCGCCAGCCACGA
CGGCGGTAAACAGGCCCTGGAAACCGTTCAGGCGCTGCTACCGGTGCTGTGCCAGGCACATGGC
TTAACCCCGGAGCAGGTGGTTGCCATCGCCTCCAATGGCGGTGGCAAGCAGGCTCTGGAAACGG
TGCAGGCCCTGCTGCCGGTGCTGTGCCAAGCCCATGGGTTGACCCCGGAACAAGTGGTGGCTAT
TGCTAGCCACGACGGTGGCAAACAGGCTCTGGAGACTGTTCAGCGTCTGCTTCCGGTGCTGTGC
CAGGCTCATGGCTTAACCCCGCAGCAAGTTGTTGCTATTGCCTCCAATATTGGTGGCAAGCAGG
CGCTGGAAACCGTTCAGCGCCTGCTGCCGGTGCTGTGCCAGGCTCATGGGCTTACCCCGGAACA
AGTTGTGGCCATTGCCTCCCATGATGGTGGCAAACAGGCGCTGGAAACTGTGCAGGCTCTGCTC
CCGGTGCTGTGCCAGGCTCATGGATTAACCCCGCAGCAAGTGGTGGCCATTGCTAGCCACGATG
GTGGCAAGCAGGCCCTGGAGACGGTTCAGCGTCTGCTCCCGGTGCTGTGCCAGGCCCATGGGCT
AACCCCGCAGCAGGTTGTTGCTATTGCCAGTCATGATGGTGGCAAACAGGCTCTGGAAACTGTG
CAGCGCCTGCTACCGGTGCTGTGCCAGGCTCACGGTCTGACCCCGCAGCAGGTGGTGGCAATCG
CAAGCAACGGTGGTGGTCGTCCGGCACTGGAAAGCATTGTGGCGCAGCTGAGCCGTCCAGACCC

-continued

GGCCCTGGCGGCTCTGACCAATGATCACCTGGTGGCCCTGGCCTGCCTGGGTGGCCGTCCGGCT

CTGGATGCCGTGAAGAAAGGTCTGGGC

Translated amino acid sequence :

(SEQ ID NO: 305)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPEQVVAIASNNGGKQALETVQALLPVLCQAHGLTPQQVVAIASNIGGKQALE

TVQRLLPVLCQAHGLTPQQVVAIASNNGGKQALETVORLLPVLCQAHGLTPEQVVAIASNGGGK

QALETVQALLPVLCQAHGLTPEQVVAIASNGGGKQALETVQALLPVLCQAHGLTPEQVVAIASN

GGGKQALETVQALLPVLCQAHGLTPEQVVAIASNNGGKQALETVQRLLPVLCQAHGLTPEQVVA

IASNIGGKQALETVQALLPVLCQAHGLTPEQVVAIASNGGGKQALETVORLLPVLCQAHGLTPE

QVVAIASNNGGKQALETVQALLPVLCQAHGLTPEQVVAIASHDGGKQALETVQALLPVLCQAHG

LTPEQVVAIASNGGGKQALETVQALLPVLCQAHGLTPEQVVAIASHDGGKQALETVORLLPVLC

QAHGLTPQQVVAIASNIGGKQALETVORLLPVLCQAHGLTPEQVVAIASHDGGKOALETVQALL

PVLCQAHGLTPQQVVAIASHDGGKQALETVQRLLPVLCQAHGLTPQQVVAIASHDGGKQALETV

QRLLPVLCQAHGLTPQQVVAIASNGGGRPALESIVAQLSRPDPALAALTNDHLVALACLGGRPA

LDAVKKGLG (*H*) *ND1-DdCBE Left mitoTALE repeat*

(SEQ ID NO: 306)

GACATCGCGGATCTGCGTACCCTGGGTTACAGCCAGCAGCAGCAGGAGAAGATCAAGCCGAAGG

TGCGCAGCACCGTGGCTCAGCACCACGAAGCCCTGGTGGGCCACGGTTTCACCCACGCTCACAT

TGTGGCCCTGAGCCAGCACCCAGCCGCGCTGGGCACCGTGGCCGTGAAATATCAGGATATGATT

GCTGCCCTGCCAGAGGCCACCCATGAAGCTATTGTGGGCGTGGGCAAGCAGTGGAGCGGTGCTC

GTGCGCTGGAGGCGCTGCTGACCGTGGCTGGTGAACTGCGTGGTCCGCCGCTGCAGCTGGACAC

CGGTCAGCTGCTGAAAATCGCGAAACGTGGCGGTGTGACCGCGGTGGAAGCCGTGCATGCTTGG

CGTAATGCTCTGACCGGTGCGCCGCTGAACCTGACCCCGGAACAAGTGGTTGCTATCGCATCCC

ATGACGGCGGTAAACAAGCCCTGGAGACCGTTCAAGCCCTGCTGCCAGTGCTGTGCCAGGCTCA

TGGTCTGACCCCGCAGCAGGTGGTGGCTATTGCCAGCAATGGCGGTGGCAAGCAGGCGCTGGAG

ACCGTGCAGCGTCTGCTGCCGGTGCTGTGCCAAGCCCATGGCCTGACCCCGCAGCAAGTIGTGG

CTATCGCCAGCAACATTGGTGGCAAACAGGCCCTGGAAACCGTGCAGCGCCTGTTACCGGTGCT

GTGCCAGGCCCATGGTCTGACCCCGGAGCAGGTGGTGGCGATCGCTAGCAACAACGGTGGCAAG

CAGGCTCTGGAAACCGTGCAGGCCCTGCTTCCGGTGCTGTGCCAGGCCCATGGGCTGACCCCGG

AACAAGTTGTGGCTATTGCCAGCCACGACGGTGGCAAACAGGCGCTGGAAACCGTGCAGGCTCT

GTTACCGGTGCTGTGCCAAGCGCATGGCCTGACCCCGGAACAGGTGGTGGCTATTGCTAGCCAC

GATGGTGGCAAGCAGGCCCTGGAGACCGTTCAGGCGCTGTTGCCGGTGCTGTGCCAGGCGCATG

GCTTAACCCCGGAACAAGTTGTTGCGATTGCTAGCAACGGTGGCGGTAAACAGGCTCTGGAGAC

CGTTCAGCGTCTGTTACCGGTGCTGTGCCAGGCACATGGCCTGACCCCGGAGCAAGTTGTTGCC

ATTGCCAGCAACATCGGCGGCAAGCAGGCTCTGGAGACCGTGCAGGCCCTGCTCCCGGTGCTGT

GCCAGGCCCATGGCTTAACCCCGGAGCAAGTTGTGGCCATTGCCAGCAACAACGGCGGTAAACA

GGCGCTGGAGACCGTTCAGCGCCTGCTACCGGTGCTGTGCCAGGCTCATGGCTTGACCCCGGAA

CAGGTTGTTGCGATTGCGAGCCATGATGGCGGCAAGCAGGCGCTGGAAACCGTTCAGGCTCTGC

TTCCGGTGCTGTGCCAGGCCCATGGATTAACCCCGGAGCAGGTTGTTGCTATTGCCAGCCATGA

TGGCGGTAAACAGGCCCTGGAGACCGTGCAGGCGCTGCTACCGGTGCTGTGCCAGGCTCATGGG

-continued

CTGACCCCGGAGCAAGTGGTTGCTATCGCGAGCAACAATGGCGGCAAGCAGGCTCTGGAAACGG

TGCAGGCCCTGCTGCCGGTGCTGTGCCAGGCCCATGGGTTAACCCCGGAACAAGTGGTGGCCAT

CGCTAGCAACGGCGGTGGCAAACAGGCCCTGGAGACTGTTCAGCGTCTGCTTCCGGTGCTGTGC

CAGGCCCATGGGCTAACCCCGCAGCAAGTGGTTGCCATTGCCAGCAATGGCGGCGGCAAGCAGG

CTCTGGAAACTGTGCAGCGCCTGCTGCCGGTGCTGTGCCAGGCTCACGGTCTGACCCCGCAACA

GGTGGTGGCAATCGCAAGCAATGGTGGTGGTCGTCCGGCACTGGAGAGCATTGTGGCTCAGCTG

AGCCGTCCAGACCCGGCCCTGGCGGCTCTGACCAACGATCACCTGGTGGCGCTGGCTTGCCTGG

GCGGTCGTCCGGCCCTGGATGCGGTGAAGAAAGGCCTGGGT

Translated amino acid sequence :

(SEQ ID NO: 307)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPEQVVAIASHDGGKQALETVQALLPVLCQAHGLTPQQVVAIASNGGGKQALE

TVQRLLPVLCQAHGLTPQQVVAIASNIGGKQALETVORLLPVLCQAHGLTPEQVVAIASNNGGK

QALETVQALLPVLCQAHGLTPEQVVAIASHDGGKQALETVQALLPVLCQAHGLTPEQVVAIASH

DGGKQALETVQALLPVLCQAHGLTPEQVVAIASNGGGKQALETVORLLPVLCQAHGLTPEQVVA

IASNIGGKQALETVQALLPVLCQAHGLTPEQVVAIASNNGGKQALETVORLLPVLCQAHGLTPE

QVVAIASHDGGKQALETVQALLPVLCQAHGLTPEQVVAIASHDGGKQALETVQALLPVLCQAHG

LTPEQVVAIASNNGGKQALETVQALLPVLCQAHGLTPEQVVAIASNGGGKQALETVORLLPVLC

QAHGLTPQQVVAIASNGGGKQALETVORLLPVLCQAHGLTPQQVVAIASNGGGRPALESIVAQL

SRPDPALAALTNDHLVALACLGGRPALDAVKKGLG

*(I) ND2-DdCBE Right mitoTALE repeat*

(SEQ ID NO: 308)

GACATCGCGGATCTGCGTACCCTGGGTTACAGCCAGCAGCAGCAGGAGAAGATCAAGCCAAAGG

TGCGCAGCACCGTGGCCCAGCACCATGAAGCTCTGGTGGGTCACGGCTTCACCCACGCGCACAT

CGTGGCTCTGAGCCAGCACCCAGCCGCGCTGGGTACCGTGGCCGTGAAATATCAGGACATGATT

GCTGCCCTGCCAGAGGCTACCCATGAAGCGATTGTGGGTGTGGGCAAGCAGTGGAGCGGTGCTC

GTGCGCTGGAGGCCCTGCTGACCGTGGCCGGTGAACTGCGTGGCCCGCCGCTGCAGCTGGATAC

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACCCCGGAACAAGTGGTTGCCATCGCATCCA

ATATCGGTGGTAAACAAGCCCTGGAGACCGTTCAAGCCCTGCTGCCAGTGCTGTGCCAGGCTCA

TGGTCTGACCCCGCAGCAGGTGGTGGCCATTGCGAGCAACAATGGCGGCAAGCAGGCGCTGGAG

ACCGTGCAGCGTCTGCTGCCGGTGCTGTGCCAAGCCCATGGCCTGACCCCGCAGCAAGTGGTTG

CTATCGCCAGCAACATTGGCGGTAAACAGGCCCTGGAAACCGTGCAGCGCCTGTTACCGGTGCT

GTGCCAGGCCCATGGTCTGACCCCGGAGCAGGTGGTGGCGATCGCTAGCAACATCGGCGGCAAG

CAGGCTCTGGAAACCGTGCAGGCCCTGCTTCCGGTGCTGTGCCAGGCCCATGGGCTGACCCCGG

AACAAGTTGTGGCTATTGCCAGCCATGATGGCGGTAAACAGGCGCTGGAAACCGTGCAGGCTCT

GTTACCGGTGCTGTGCCAAGCGCATGGCCTGACCCCGGAACAGGTGGTGGCTATTGCGAGCAAT

GGCGGTGGCAAGCAGGCCCTGGAGACCGTTCAGGCGCTGTTGCCGGTGCTGTGCCAGGCGCATG

GCTTAACCCCGGAACAAGTTGTTGCGATCGCTAGCAACAACGGTGGCAAACAGGCTCTGGAGAC

CGTTCAGCGTCTGTTACCGGTGCTGTGCCAGGCACATGGCCTGACCCCGGAGCAAGTTGTTGCC

ATTGCCAGCCACGATGGTGGCAAGCAGGCTCTGGAGACCGTGCAGGCCCTGCTCCCGGTGCTGT

-continued

GCCAGGCCCATGGCTTAACCCCGGAGCAAGTIGTGGCTATCGCCAGCAACGGTGGCGGTAAACA

GGCGCTGGAGACCGTTCAGCGCCTGCTACCGGTGCTGTGCCAGGCTCATGGCTTGACCCCGGAA

CAGGTTGTTGCCATTGCGTCCAATATCGGCGGCAAGCAGGCGCTGGAAACCGTTCAGGCTCTGC

TTCCGGTGCTGTGCCAGGCCCATGGATTAACCCCGGAGCAGGTTGTGGCGATTGCGAGCAACGG

CGGTGGCAAACAGGCCCTGGAGACCGTGCAGGCGCTGCTACCGGTGCTGTGCCAGGCTCATGGG

CTGACCCCGGAGCAAGTGGTTGCTATTGCTAGCAATGGCGGCGGCAAGCAGGCTCTGGAAACGG

TGCAGGCCCTGCTGCCGGTGCTGTGCCAGGCCCATGGGTTAACCCCGGAACAAGTGGTGGCCAT

CGCTTCCAATATTGGCGGTAAACAGGCCCTGGAGACTGTTCAGCGTCTGCTTCCGGTGCTGTGC

CAGGCCCATGGGCTAACCCCGCAGCAAGTTGTTGCTATTGCCTCCAATGGCGGTGGCAAGCAGG

CTCTGGAAACTGTGCAGCGCCTGCTGCCGGTGCTGTGCCAGGCTCACGGCCTGACCCCGCAGCA

AGTTGTGGCAATCGCAAGCAATGGTGGTGGTCGTCCGGCTCTGGAGAGCATTGTGGCGCAGCTG

AGCCGTCCAGACCCGGCCCTGGCGGCTCTGACCAATGATCACCTGGTGGCCCTGGCCTGCCTGG

GTGGCCGTCCGGCTCTGGATGCCGTGAAGAAAGGTCTGGGC

Translated amino acid sequence:

(SEQ ID NO: 309)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPEQVVAIASNIGGKQALETVQALLPVLCQAHGLTPQQVVAIASNNGGKQALE

TVQRLLPVLCQAHGLTPQQVVAIASNIGGKQALETVORLLPVLCQAHGLTPEQVVAIASNIGGK

QALETVQALLPVLCQAHGLTPEQVVAIASHDGGKQALETVQALLPVLCQAHGLTPEQVVAIASN

GGGKQALETVQALLPVLCQAHGLTPEQVVAIASNNGGKQALETVORLLPVLCQAHGLTPEQVVA

IASHDGGKQALETVQALLPVLCQAHGLTPEQVVAIASNGGGKQALETVORLLPVLCQAHGLTPE

QVVAIASNIGGKQALETVQALLPVLCQAHGLTPEQVVAIASNGGGKQALETVQALLPVLCQAHG

LTPEQVVAIASNGGGKQALETVQALLPVLCQAHGLTPEQVVAIASNIGGKQALETVORLLPVLC

QAHGLTPQQVVAIASNGGGKQALETVQRLLPVLCQAHGLTPQQVVAIASNGGGRPALESIVAQL

SRPDPALAALTNDHLVALACLGGRPALDAVKKGLG

*(J) ND2-DdCBE Left mitoTALE repeat*

(SEQ ID NO: 310)

GACATCGCGGATCTGCGTACCCTGGGTTACAGCCAGCAGCAGCAGGAGAAGATCAAGCCAAAGG

TGCGCAGCACCGTGGCCCAGCACCATGAAGCTCTGGTGGGTCACGGCTTCACCCACGCGCACAT

CGTGGCTCTGAGCCAGCACCCAGCCGCGCTGGGTACCGTGGCCGTGAAATATCAGGACATGATT

GCTGCCCTGCCAGAGGCTACCCATGAAGCGATTGTGGGTGTGGGCAAGCAGTGGAGCGGTGCTC

GTGCGCTGGAGGCCCTGCTGACCGTGGCCGGTGAACTGCGTGGCCCGCCGCTGCAGCTGGATAC

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACCCCGGAACAAGTGGTGGCTATCGCGTCCC

ATGATGGTGGTAAACAGGCTCTGGAGACCGTGCAAGCTCTGCTGCCAGTGCTGTGCCAGGCCCA

TGGTCTGACCCCGCAGCAGGTGGTGGCTATTGCCAGCAATGGCGGTGGCAAGCAGGCGCTGGAG

ACCGTGCAGCGTCTGCTGCCGGTGCTGTGCCAGGCTCATGGCCTGACCCCGCAGCAAGTIGTGG

CTATTGCCAGCAACGGTGGCGGTAAACAGGCCCTGGAGACCGTGCAGCGCCTGTTACCGGTGCT

GTGCCAAGCCCATGGCCTGACCCCGGAGCAGGTGGTGGCGATCGCTAGCAACATCGGCGGCAAG

CAGGCTCTGGAAACCGTGCAGGCCCTGCTTCCGGTGCTGTGCCAGGCCCATGGCTTAACCCCGG

AACAGGTTGTTGCTATTGCCAGCAACAACGGCGGTAAACAGGCGCTGGAAACCGTGCAGGCTCT

GTTACCGGTGCTGTGCCAGGCCCATGGGCTGACCCCGGAACAAGTTGTGGCTATTGCGAGCCAT

-continued

GATGGCGGCAAGCAGGCCCTGGAAACCGTGCAGGCGCTGTTGCCGGTGCTGTGCCAAGCCCATG
GATTAACCCCGGAACAAGTTGTTGCGATCGCTAGCAACATTGGCGGTAAACAGGCTCTGGAAAC
CGTTCAGCGTCTGTTACCGGTGCTGTGCCAGGCGCATGGTCTGACCCCGGAACAGGTTGTGGCC
ATTGCCTCCAATGGCGGTGGCAAGCAGGCTCTGGAGACCGTTCAGGCCCTGCTCCCGGTGCTGT
GCCAAGCGCATGGCCTGACCCCGGAACAGGTGGTGGCTATCGCCAGCAACATTGGTGGCAAACA
GGCGCTGGAGACCGTTCAGCGCCTGCTACCGGTGCTGTGCCAGGCACATGGTCTGACCCCGGAG
CAAGTTGTGGCCATTGCTAGCCACGATGGTGGCAAGCAGGCGCTGGAAACCGTTCAGGCTCTGC
TTCCGGTGCTGTGCCAGGCCCATGGTTTAACCCCGGAACAAGTGGTTGCCATTGCGTCCAATGG
TGGCGGTAAACAGGCCCTGGAAACCGTTCAGGCGCTGCTACCGGTGCTGTGCCAGGCTCATGGG
CTGACCCCGGAGCAAGTGGTTGCTATTGCTTCCCATGATGGCGGCAAGCAGGCTCTGGAAACGG
TGCAGGCCCTGCTGCCGGTGCTGTGCCAAGCCCATGGGTTAACCCCGGAACAGGTGGTTGCGAT
TGCTAGCCACGACGGCGGTAAACAGGCCCTGGAAACGGTTCAGCGTCTGCTTCCGGTGCTGTGC
CAGGCCCATGGACTTACCCCGCAGCAGGTTGTGGCGATTGCCTCCAATGGCGGTGGCAAGCAGG
CTCTGGAAACTGTGCAGCGCCTGCTGCCGGTGCTGTGCCAGGCTCATGGTTTAACCCCGGAGCA
GGTTGTTGCCATCGCCAGCCACGACGGTGGCAAACAGGCGCTGGAAACTGTGCAGGCTCTGCTC
CCGGTGCTGTGCCAGGCTCATGGACTTACCCCGGAGCAGGTGGTTGCCATTGCTAGCAACATTG
GTGGCAAGCAGGCCCTGGAGACTGTTCAGGCGCTGTTACCGGTGCTGTGCCAGGCCCATGGGTT
AACCCCGGAGCAAGTTGTTGCCATTGCCTCCAATATTGGTGGCAAACAGGCTCTGGAGACTGTT
CAGGCCCTGCTGCCGGTGCTGTGCCAGGCTCACGGTCTGACCCCGCAGCAAGTGGTGGCAATCG
CAAGCAATGGTGGTGGTCGTCCGGCTCTGGAGAGCATTGTGGCGCAGCTGAGCCGTCCAGACCC
GGCCCTGGCGGCTCTGACCAATGATCACCTGGTGGCCCTGGCCTGCCTGGGTGGCCGTCCGGCT
CTGGATGCCGTGAAGAAAGGTCTGGGC

Translated amino acid sequence:

(SEQ ID NO: 311)

DIADLRTLGYSQQQQEKIKPKVRSTVAQHHEALVGHGFTHAHIVALSQHPAALGTVAVKYQDMI
AALPEATHEAIVGVGKOWSGARALEALLTVAGELRGPPLOLDTGOLLKIAKRGGVTAVEAVHAW
RNALTGAPLNLTPEQVVAIASNIGGKQALETVQALLPVLCQAHGLTPQQVVAIASNNGGKQALE
TVQRLLPVLCQAHGLTPQQVVAIASNIGGKQALETVQRLLPVLCQAHGLTPEQVVAIASNIGGK
QALETVQALLPVLCQAHGLTPEQVVAIASHDGGKQALETVQALLPVLCQAHGLTPEQVVAIASN
GGGKQALETVQALLPVLCQAHGLTPEQVVAIASNNGGKQALETVORLLPVLCQAHGLTPEQVVA
IASHDGGKQALETVQALLPVLCQAHGLTPEQVVAIASNGGGKQALETVORLLPVLCQAHGLTPE
QVVAIASNIGGKQALETVQALLPVLCQAHGLTPEQVVAIASNGGGKQALETVQALLPVLCQAHG
LTPEQVVAIASNGGGKQALETVQALLPVLCQAHGLTPEQVVAIASNIGGKQALETVQRLLPVLC
QAHGLTPQQVVAIASNGGGKQALETVORLLPVLCQAHGLTPQQVVAIASNGGGRPALESIVAQL
SRPDPALAALTNDHLVALACLGGRPALDAVKKGLG (*K*) *ND4-DdCBE Right mitoTALE repeat*

(SEQ ID NO: 312)

GACATCGCGGATCTGCGTACCCTGGGTTACAGCCAGCAGCAGCAGGAGAAGATCAAGCCAAAGG
TGCGCAGCACCGTGGCCCAGCACCATGAAGCTCTGGTGGGTCACGGCTTCACCCACGCGCACAT
CGTGGCTCTGAGCCAGCACCCAGCCGCGCTGGGTACCGTGGCCGTGAAATATCAGGACATGATT
GCTGCCCTGCCAGAGGCTACCCATGAAGCGATTGTGGGTGTGGGCAAGCAGTGGAGCGGTGCTC
GTGCGCTGGAGGCCCTGCTGACCGTGGCCGGTGAACTGCGTGGCCCGCCGCTGCAGCTGGATAC

-continued

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACCCCGGAACAAGTGGTTGCGATTGCGTCCC

ATGATGGTGGTAAACAAGCCCTGGAGACCGTTCAAGCTCTGCTGCCAGTGCTGTGCCAGGCTCA

TGGTCTGACCCCGCAGCAGGTGGTGGCTATTGCCAGCCATGATGGCGGCAAGCAGGCTCTGGAG

ACCGTGCAGCGTCTGCTGCCGGTGCTGTGCCAAGCCCATGGCCTGACCCCGCAGCAAGTIGTGG

CTATTGCCAGCAACGGCGGTGGCAAACAGGCGCTGGAAACCGTGCAGCGCCTGTTACCGGTGCT

GTGCCAAGCGCATGGTCTGACCCCGGAGCAGGTGGTGGCCATCGCTAGCAACAACGGTGGCAAG

CAGGCCCTGGAAACCGTGCAGGCGCTGTTGCCGGTGCTGTGCCAGGCCCATGGCTTAACCCCGG

AACAAGTGGTGGCCATTGCGAGCAATGGTGGCGGTAAACAGGCTCTGGAAACCGTGCAGGCCCT

GCTTCCGGTGCTGTGCCAGGCCCATGGGCTGACCCCGGAACAAGTIGTGGCTATCGCCAGCAAC

ATCGGCGGCAAGCAGGCGCTGGAGACCGTTCAGGCTCTGTTACCGGTGCTGTGCCAGGCGCATG

GCCTGACCCCGGAACAGGTGGTGGCGATCGCTAGCAACATTGGCGGTAAACAGGCCCTGGAGAC

CGTTCAGCGCCTGCTCCCGGTGCTGTGCCAGGCCCATGGTCTGACCCCGGAACAGGTTGTTGCT

ATTGCCAGCAACAACGGCGGCAAGCAGGCCCTGGAGACCGTGCAGGCGCTGCTACCGGTGCTGT

GCCAGGCCCATGGACTGACCCCGGAGCAGGTTGTGGCCATCGCGTCCAATGGCGGTGGCAAACA

GGCTCTGGAGACCGTTCAGCGTCTGTTACCGGTGCTGTGCCAGGCACATGGCCTGACCCCGGAG

CAAGTTGTTGCCATCGCTAGCAACATTGGTGGCAAGCAGGCGCTGGAAACCGTTCAGCGCCTGC

TACCGGTGCTGTGCCAGGCTCATGGCTTAACCCCGGAGCAGGTTGTCGCCATTGCCAGCAACAA

TGGTGGCAAACAGGCTCTGGAAACTGTGCAGGCCCTGCTACCGGTGCTGTGCCAGGCCCATGGG

TTAACCCCGGAACAGGTTGTGGCCATTGCCTCCAATAACGGTGGCAAGCAGGCGCTGGAAACGG

TGCAGGCTCTGCTTCCGGTGCTGTGCCAGGCTCATGGGCTGACCCCGGAGCAAGTGGTTGCTAT

TGCGTCCAACATTGGTGGCAAACAGGCCCTGGAAACCGTTCAGGCGCTGCTCCCGGTGCTGTGC

CAGGCCCATGGGCTAACCCCGGAACAGGTGGTTGCCATTGCCTCCAACAATGGTGGCAAGCAGG

CCCTGGAAACGGTTCAGCGTCTGCTTCCGGTGCTGTGCCAGGCCCATGGGCTTACCCCGCAGCA

AGTTGTTGCTATCGCCAGCAATATTGGTGGCAAACAGGCTCTGGAAACGGTGCAGCGCCTGCTA

CCGGTGCTGTGCCAGGCTCATGGTTTAACCCCGCAGCAGGTGGTTGCGATTGCCTCCAACAACG

GTGGCAAGCAGGCGCTGGAAACTGTTCAGCGTCTGCTCCCGGTGCTGTGCCAGGCTCACGGCCT

GACCCCGCAGCAAGTGGTGGCTATCGCCTCCAACGGTGGTGGTCGCCCGGCTCTGGAAAGCATT

GTGGCGCAGCTGAGCCGTCCAGACCCGGCCCTGGCGGCTCTGACCAATGATCACCTGGTGGCCC

TGGCCTGCCTGGGTGGCCGTCCGGCTCTGGATGCCGTGAAGAAAGGTCTGGGC

Translated amino acid sequence:

(SEQ ID NO: 313)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPEQVVAIASHDGGKQALETVQALLPVLCQAHGLTPQQVVAIASHDGGKQALE

TVQRLLPVLCQAHGLTPQQVVAIASNGGGKQALETVORLLPVLCQAHGLTPEQVVAIASNNGGK

QALETVQALLPVLCQAHGLTPEQVVAIASNGGGKQALETVQALLPVLCQAHGLTPEQVVAIASN

IGGKQALETVQALLPVLCQAHGLTPEQVVAIASNIGGKQALETVORLLPVLCQAHGLTPEQVVA

IASNNGGKQALETVQALLPVLCQAHGLTPEQVVAIASNGGGKQALETVORLLPVLCQAHGLTPE

QVVAIASNIGGKQALETVORLLPVLCQAHGLTPEQVVAIASNNGGKQALETVQALLPVLCQAHG

LTPEQVVAIASNNGGKQALETVQALLPVLCQAHGLTPEQVVAIASNIGGKQALETVQALLPVLC

QAHGLTPEQVVAIASNNGGKQALETVORLLPVLCQAHGLTPQQVVAIASNIGGKQALETVORLL

-continued

PVLCQAHGLTPQQVVAIASNNGGKQALETVORLLPVLCQAHGLTPQQVVAIASNGGGRPALESI

VAQLSRPDPALAALTNDHLVALACLGGRPALDAVKKGLG

*(L) ND4-DdCBE Left mitoTALE repeat*

(SEQ ID NO: 314)

GACATCGCGGATCTGCGTACCCTGGGTTACAGCCAGCAGCAGCAGGAGAAGATCAAGCCAAAGG

TGCGCAGCACCGTGGCCCAGCACCATGAAGCTCTGGTGGGTCACGGCTTCACCCACGCGCACAT

CGTGGCTCTGAGCCAGCACCCAGCCGCGCTGGGTACCGTGGCCGTGAAATATCAGGACATGATT

GCTGCCCTGCCAGAGGCTACCCATGAAGCGATTGTGGGTGTGGGCAAGCAGTGGAGCGGTGCTC

GTGCGCTGGAGGCCCTGCTGACCGTGGCCGGTGAACTGCGTGGCCCGCCGCTGCAGCTGGATAC

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACCCCGGAACAGGTGGTGGCAATCGCAAGCA

ATAATGGTGGTAAACAGGCTCTGGAAACCGTGCAAGCTCTGCTGCCAGTTCTGTGCCAGGCTCA

TGGTCTGACCCCGCAGCAGGTGGTGGCTATTGCCAGCCATGATGGCGGCAAGCAGGCCCTGGAG

ACCGTGCAGCGTCTGCTGCCGGTGCTGTGCCAGGCCCATGGCCTGACCCCGCAGCAAGTIGTGG

CTATTGCCAGCAACGGCGGTGGCAAACAGGCTCTGGAGACCGTGCAGCGCCTGTTACCGGTGCT

GTGCCAAGCCCATGGTCTGACCCCGGAGCAGGTGGTGGCGATCGCTAGCAACATTGGTGGCAAG

CAGGCCCTGGAAACCGTGCAGGCGCTGTTGCCGGTGCTGTGCCAAGCCCATGGGCTGACCCCGG

AACAAGTTGTTGCCATTGCCAGCAACAATGGTGGCAAACAGGCTCTGGAAACTGTGCAGGCCCT

GCTTCCGGTGCTGTGCCAGGCCCATGGATTAACCCCGGAACAAGTIGTGGCTATTGCGAGCAAT

GGCGGCGGCAAGCAGGCGCTGGAAACCGTGCAGGCTCTGTTACCGGTGCTGTGCCAGGCGCATG

GCCTGACCCCGGAGCAAGTGGTGGCCATCGCTAGCAACATTGGCGGTAAACAGGCGCTGGAGAC

CGTTCAGCGTCTGTTACCGGTGCTGTGCCAGGCACATGGCCTTACCCCGGAACAAGTIGTGGCC

ATTGCCAGCAACATCGGCGGCAAGCAGGCCCTGGAAACGGTGCAGGCGCTGCTCCCGGTGCTGT

GCCAGGCCCATGGGTTAACCCCGGAACAAGTGGTTGCTATTGCTAGCCATGATGGCGGTAAACA

GGCCCTGGAGACCGTTCAGCGCCTGCTACCGGTGCTGTGCCAGGCCCATGGTTTAACCCCGGAA

CAGGTTGTTGCGATTGCTAGCCACGATGGCGGCAAGCAGGCTCTGGAGACCGTTCAGGCCCTGC

TCCCGGTGCTGTGCCAGGCCCATGGGCTTACCCCGGAGCAAGTTGTTGCTATTGCCTCCAATAT

TGGCGGTAAACAGGCGCTGGAAACCGTTCAGGCTCTGCTTCCGGTGCTGTGCCAGGCTCATGGC

CTCACCCCGGAACAAGTIGTGGCGATTGCGTCCCATGATGGCGGCAAGCAGGCCCTGGAAACTG

TGCAGGCGCTGCTACCGGTGCTGTGCCAGGCCCATGGGCTAACCCCGGAACAGGTGGTTGCGAT

TGCTAGCAACAACGGCGGTAAACAGGCTCTGGAGACTGTTCAGCGTCTGCTTCCGGTGCTGTGC

CAGGCTCATGGGCTGACCCCGCAGCAAGTGGTTGCTATTGCCAGCAATGGCGGTGGCAAGCAGG

CGCTGGAGACTGTTCAGCGCCTGCTCCCGGTGCTGTGCCAGGCTCATGGTTTAACCCCGGAGCA

GGTTGTGGCGATCGCCAGCAATGGTGGCGGTAAACAGGCTCTGGAAACGGTGCAGGCCCTGCTC

CCGGTGCTGTGCCAGGCTCATGGACTGACCCCGGAGCAAGTTGTTGCCATTGCGTCCCACGACG

GCGGCAAGCAGGCGCTGGAGACGGTGCAGGCTCTGCTCCCGGTGCTGTGCCAGGCTCACGGTCT

GACCCCGCAACAGGTGGTGGCAATCGCAAGCAACGGTGGTGGTCGTCCGGCACTGGAGAGCATT

GTGGCGCAGCTGAGCCGTCCAGACCCGGCCCTGGCGGCTCTGACCAATGATCACCTGGTGGCCC

TGGCCTGCCTGGGTGGCCGTCCGGCTCTGGATGCCGTGAAGAAAGGTCTGGGC

-continued

Translated amino acid sequence:

(SEQ ID NO: 315)

DIADLRTLGYSQQQQEKIKPKVRSTVAQHHEALVGHGFTHAHIVALSQHPAALGTVAVKYQDMI
AALPEATHEAIVGVGKQWSGARALEALLTVAGELRGPPLQLDTGQLLKIAKRGGVTAVEAVHAW
RNALTGAPLNLTPEQVVAIASNNGGKQALETVQALLPVLCQAHGLTPQQVVAIASHDGGKQALE
TVQRLLPVLCQAHGLTPQQVVAIASNGGGKQALETVQRLLPVLCQAHGLTPEQVVAIASNIGGK
QALETVQALLPVLCQAHGLTPEQVVAIASNNGGKQALETVQALLPVLCQAHGLTPEQVVAIASN
GGGKQALETVQALLPVLCQAHGLTPEQVVAIASNIGGKQALETVQRLLPVLCQAHGLTPEQVVA
IASNIGGKQALETVQALLPVLCQAHGLTPEQVVAIASHDGGKQALETVQRLLPVLCQAHGLTPE
QVVAIASHDGGKQALETVQALLPVLCQAHGLTPEQVVAIASNIGGKQALETVQALLPVLCQAHG
LTPEQVVAIASHDGGKQALETVQALLPVLCQAHGLTPEQVVAIASNNGGKQALETVQRLLPVLC
QAHGLTPQQVVAIASNGGGKQALETVQRLLPVLCQAHGLTPEQVVAIASNGGGKQALETVQALL
PVLCQAHGLTPEQVVAIASHDGGKQALETVQALLPVLCQAHGLTPQQVVAIASNGGGRPALESI
VAQLSRPDPALAALTNDHLVALACLGGRPALDAVKKGLG

*(M) ND5.1-DdCBE Right mitoTALE repeat*

(SEQ ID NO: 316)

GACATCGCGGATCTGCGTACCCTGGGTTACAGCCAGCAGCAGCAGGAGAAGATCAAGCCAAAGG
TGCGCAGCACCGTGGCCCAGCACCATGAAGCTCTGGTGGGTCACGGCTTCACCCACGCGCACAT
CGTGGCTCTGAGCCAGCACCCAGCCGCGCTGGGTACCGTGGCCGTGAAATATCAGGACATGATT
GCTGCCCTGCCAGAGGCTACCCATGAAGCGATTGTGGGTGTGGGCAAGCAGTGGAGCGGTGCTC
GTGCGCTGGAGGCCCTGCTGACCGTGGCCGGTGAACTGCGTGGCCCGCCGCTGCAGCTGGATAC
CGGCCAGCTGCTGAAAATCGCGAAACGTGGCGGTGTGACCGCTGTGGAAGCTGTGCATGCCTGG
CGTAATGCTCTGACCGGTGCCCCGCTGAACCTGACCCCACAGCAGGTGGTGGCAATCGCAAGCC
ACGACGGAGGCAAGCAGGCCCTGGAGACCGTGCAGAGGCTGCTGCCCGTGCTGTGCCAGGCACA
CGGACTGACACCTGAACAGGTCGTGGCAATCGCATCCAACGGAGGCGGCAAGCAGGCCCTGGAA
ACCGTGCAGCGCCTGTTACCCGTGCTGTGCCAGGCCCACGGCCTGACACCCCAGCAGGTGGTGG
CCATCGCCTCTAATGGAGGGGGCAAGCAGGCCCTGGAGACGGTGCAGCGGCTGCTGCCTGTGCT
GTGCCAGGCTCATGGACTGACACCAGAACAGGTGGTCGCAATCGCAAGCAACGGAGGTGGCAAG
CAGGCCCTGGAGACTGTGCAGGCCCTGCTTCCCGTGCTGTGCCAGGCTCACGGACTGACACCTC
AGCAGGTCGTCGCCATCGCCTCCAACAATGGTGGCAAGCAGGCCCTGGAGACAGTGCAGAGACT
GCTGCCAGTGCTGTGCCAAGCCCATGGACTGACACCACAGCAGGTCGTCGCTATCGCCTCTAAT
AACGGCGGCAAGCAGGCCCTGGAGACGGTACAGAGGCTGTTACCCGTGCTGTGCCAAGCACACG
GACTGACACCAGAGCAGGTCGTCGCAATCGCCAGCAATATCGGTGGCAAGCAGGCCCTGGAGAC
GGTCCAGCGCCTGCTCCCCGTGCTGTGCCAAGCCCACGGCCTGACCCCTCAGCAGGTCGTGGCT
ATTGCTAGCAATAACGGGGGCAAGCAGGCCCTGGAGACGGTTCAGCGGCTGTTGCCCGTGCTGT
GCCAAGCCCACGGTCTGACCCCTCAGCAGGTGGTCGCTATTGCTTCTAATGGAGGAGGCAAGCA
GGCCCTGGAGACGGTACAGAGACTGTTACCTGTGCTGTGCCAGGCACATGGCCTGACACCAGAG
CAGGTGGTCGCTATCGCCAGCAACATAGGTGGCAAGCAGGCCCTGGAGACGGTACAGAGGCTGC
TTCCCGTGCTGTGCCAAGCTCATGGCCTGACACCTGAACAGGTGGTCGCCATTGCTAGCAATAA
CGGTGGCAAGCAGGCCCTGGAGACGGTACAGCGGCTGTTACCAGTGCTGTGCCAAGCACATGGC
TTAACCCCTCAACAGGTCGTCGCAATTGCCTCTAATATCGGAGGCAAGCAGGCCCTGGAGACGG
TACAGCGGCTGCTCCCCGTGCTGTGCCAGGCGCACGGCCTGACTCCTCAGCAGGTCGTGGCAAT

-continued

CGCCAGCAACATCGGCGGCAGACCTGCCCTGGAGAGCATTGTGGCGCAGCTGAGCCGTCCAGAC

CCGGCCCTGGCGGCTCTGACCAATGATCACCTGGTGGCCCTGGCCTGCCTGGGTGGCCGTCCGG

CTCTGGATGCCGTGAAGAAAGGTCTGGGC

Translated amino acid sequence:

(SEQ ID NO: 317)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPQQVVAIASHDGGKQALETVORLLPVLCQAHGLTPEQVVAIASNGGGKQALE

TVQRLLPVLCQAHGLTPQQVVAIASNGGGKQALETVQRLLPVLCQAHGLTPEQVVAIASNGGGK

QALETVQALLPVLCQAHGLTPQQVVAIASNNGGKQALETVORLLPVLCQAHGLTPQQVVAIASN

NGGKQALETVQRLLPVLCQAHGLTPEQVVAIASNIGGKQALETVORLLPVLCQAHGLTPQQVVA

IASNNGGKQALETVQRLLPVLCQAHGLTPQQVVAIASNGGGKQALETVORLLPVLCQAHGLTPE

QVVAIASNIGGKQALETVQRLLPVLCQAHGLTPEQVVAIASNNGGKQALETVORLLPVLCQAHG

LTPQQVVAIASNIGGKQALETVORLLPVLCQAHGLTPQQVVAIASNIGGRPALESIVAQLSRPD

PALAALTNDHLVALACLGGRPALDAVKKGLG (*N*) *ND5.1-DdCBE Left mitoTALE repeat*

(SEQ ID NO: 318)

CTGACCCCTGAGCAGGTGGTGGCCATCGCCAGCAATATCGGAGGCAAGCAGGCCCTGGAGACCG

TGCAGGCCCTGCTGCCCGTGCTGTGCCAGGCACACGGACTGACACCTCAGCAGGTCGTCGCCAT

CGCCTCCAACAATGGCGGCAAGCAGGCCCTGGAAACCGTGCAGAGGCTGTTACCCGTGCTGTGC

CAGGCCCACGGCCTGACACCCCAGCAGGTGGTGGCAATCGCATCTCACGATGGGGGCAAGCAGG

CCCTGGAGACGGTGCAGCGCCTGCTGCCTGTGCTGTGCCAGGCTCATGGACTGACACCAGAACA

GGTCGTGGCCATCGCCAGCAACATTGGCGGCAAGCAGGCCCTGGAGACTGTCCAGGCCCTGTTA

CCCGTGCTGTGCCAAGCCCATGGACTGACACCTGAACAGGTCGTGGCAATCGCATCCAATGGAG

GTGGCAAGCAGGCCCTGGAGACAGTGCAGGCCCTGCTGCCAGTGCTGTGCCAGGCTCACGGCCT

GACACCAGAACAGGTGGTCGCAATCGCATCTAATGGAGGAGGCAAGCAGGCCCTGGAGACGGTA

CAGGCCCTGTTGCCCGTGCTGTGCCAAGCCCACGGACTGACACCAGAGCAGGTCGTCGCTATTG

CTTCCAACATTGGAGGCAAGCAGGCCCTGGAGACGGTCCAGCGGCTGCTTCCCGTGCTGTGCCA

AGCTCATGGCCTGACACCAGAGCAGGTGGTCGCTATTGCCTCCAACAATGGAGGCAAGCAGGCC

CTGGAGACGGTTCAGGCCCTGCTTCCCGTGCTGTGCCAGGCTCATGGTCTGACACCCGAACAGG

TGGTCGCTATCGCCTCTCACGATGGAGGCAAGCAGGCCCTGGAGACGGTACAGAGGCTGTTACC

TGTGCTGTGCCAGGCCCATGGGCTGACCCCAGAACAGGTGGTCGCCATCGCCAGCAACATCGGC

GGCAAGCAGGCCCTGGAGACGGTACAGGCCCTGCTCCCCGTGCTGTGCCAAGCACATGGCCTGA

CACCCGAGCAGGTCGTGGCTATTGCTAGCAACAACGGGGGCAAGCAGGCCCTGGAGACGGTACA

GGCCCTGCTACCAGTGCTGTGCCAAGCGCACGGGCTGACCCCAGAGCAGGTCGTCGCAATCGCC

TCTAACAACGGTGGCAAGCAGGCCCTGGAGACGGTACAGGCCCTGCTGCCCGTGCTGTGCCAAG

CGCATGGGCTGACTCCAGAACAGGTGGTGGCTATCGCCAGCAACATTGGAGGCAAGCAGGCCCT

GGAGACGGTACAGCGGCTGCTACCCGTGCTGTGCCAAGCGCACGGTCTGACACCTCAGCAGGTG

GTCGCTATCGCTTCTAACATAGGGGGCAAGCAGGCCCTGGAGACGGTACAGCGGCTGCTGCCCG

TGCTGTGCCAAGCGCACGGACTGACCCCACAGCAGGTCGTCGCTATCGCCTCTAACGGAGGAGG

CAGACCCGCCCTGGAG

-continued

Translated amino acid sequence :

(SEQ ID NO: 319)

LTPEQVVAIASNIGGKQALETVQALLPVLCQAHGLTPQQVVAIASNNGGKQALETVORLLPVLC

QAHGLTPQQVVAIASHDGGKQALETVQRLLPVLCQAHGLTPEQVVAIASNIGGKQALETVQALL

PVLCQAHGLTPEQVVAIASNGGGKQALETVQALLPVLCQAHGLTPEQVVAIASNGGGKQALETV

QALLPVLCQAHGLTPEQVVAIASNIGGKQALETVORLLPVLCQAHGLTPEQVVAIASNNGGKQA

LETVQALLPVLCQAHGLTPEQVVAIASHDGGKQALETVORLLPVLCQAHGLTPEQVVAIASNIG

GKQALETVQALLPVLCQAHGLTPEQVVAIASNNGGKQALETVQALLPVLCQAHGLTPEQVVAIA

SNNGGKQALETVQALLPVLCQAHGLTPEQVVAIASNIGGKQALETVORLLPVLCQAHGLTPQQV

VAIASNIGGKQALETVORLLPVLCQAHGLTPQQVVAIASNGGGRPALE (*O*) *ND5.2-DdCBE Right mitoTALE repeat*

(SEQ ID NO: 320)

GACATCGCGGATCTGCGTACCCTGGGTTACAGCCAGCAGCAGCAGGAGAAGATCAAGCCGAAGG

TGCGCAGCACCGTGGCTCAGCACCACGAAGCCCTGGTGGGCCACGGTTTCACCCACGCTCACAT

CGTGGCCCTGAGCCAGCACCCAGCCGCGCTGGGCACCGTGGCCGTGAAATATCAGGACATGATT

GCTGCCCTGCCAGAGGCCACCCATGAAGCTATTGTGGGCGTGGGCAAGCAGTGGAGCGGTGCTC

GTGCGCTGGAGGCGCTGCTGACCGTGGCTGGTGAACTGCGTGGTCCGCCGCTGCAGCTGGATAC

CGGTCAGCTGCTGAAAATTGCCAAACGTGGCGGTGTGACCGCGGTGGAAGCCGTGCATGCTTGG

CGTAATGCTCTGACCGGTGCGCCGCTGAACCTGACCCCGCAGCAGGTGGTGGCTATTGCCAGCA

ACAACGGCGGTAAACAGGCTCTGGAGACCGTGCAGCGTCTGCTGCCGGTGCTGTGCCAGGCTCA

TGGTCTGACCCCGGAGCAGGTGGTGGCCATTGCTAGCCATGATGGCGGCAAGCAGGCGCTGGAA

ACCGTGCAGCGCCTGTTACCGGTGCTGTGCCAAGCCCATGGTCTGACCCCGCAGCAAGTIGTGG

CTATTGCGAGCAACGGCGGTGGCAAACAGGCCCTGGAAACCGTTCAGCGTCTGTTACCGGTGCT

GTGCCAGGCCCATGGCCTGACCCCGGAACAAGTGGTGGCTATCGCCAGCAACATTGGTGGCAAG

CAGGCCCTGGAAACCGTGCAGGCGCTGTTGCCGGTGCTGTGCCAAGCCCATGGGCTGACCCCGC

AGCAAGTGGTTGCGATCGCTAGCAACAACGGTGGCAAACAGGCTCTGGAAACCGTTCAGCGCCT

GCTTCCGGTGCTGTGCCAAGCGCATGGCTTAACCCCGCAGCAAGTTGTGGCCATTGCGAGCAAC

AACGGTGGCAAGCAGGCGCTGGAGACCGTTCAGCGTCTGCTTCCGGTGCTGTGCCAGGCGCATG

GCCTGACCCCGGAGCAAGTGGTGGCTATTGCTAGCCACGATGGTGGCAAACAGGCCCTGGAGAC

CGTGCAGCGCCTGCTCCCGGTGCTGTGCCAGGCCCATGGATTAACCCCGCAGCAAGTGGTGGCC

ATCGCCAGCAATGGCGGCGGCAAGCAGGCTCTGGAAACTGTGCAGCGTCTGTTACCGGTGCTGT

GCCAGGCCCATGGGTTAACCCCGCAGCAGGTTGTTGCCATTGCCTCCAATAATGGCGGTAAACA

GGCGCTGGAGACTGTGCAGCGCCTGCTACCGGTGCTGTGCCAGGCACATGGTCTGACCCCGGAA

CAAGTTGTTGCCATTGCGTCCCATGATGGCGGCAAGCAGGCCCTGGAGACTGTTCAGCGTCTGC

TCCCGGTGCTGTGCCAGGCCCATGGTTTAACCCCGGAACAAGTTGTGGCCATTGCTAGCCACGA

TGGCGGTAAACAGGCTCTGGAAACTGTTCAGCGCCTGCTGCCGGTGCTGTGCCAAGCACATGGC

TTAACCCCGGAACAGGTTGTTGCTATTGCCAGCAACATCGGCGGCAAGCAGGCTCTGGAGACCG

TTCAGGCCCTGTTGCCGGTGCTGTGCCAGGCCCATGGGCTTACCCCGGAACAAGTGGTTGCCAT

CGCCAGCAACATTGGCGGTAAACAGGCGCTGGAAACCGTTCAGGCTCTGTTGCCGGTGCTGTGC

CAGGCTCATGGCCTTACCCCGCAGCAAGTIGTGGCGATTGCTAGCAATGGCGGTGGCAAGCAGG

CGCTGGAGACGGTTCAGCGTCTGCTACCGGTGCTGTGCCAGGCTCATGGATTGACCCCGCAGCA

GGTCGTGGCCATTGCCTCCAATAACGGTGGCAAACAGGCGCTGGAGACAGTTCAGCGCCTGCTG

-continued

CCGGTGCTGTGCCAGGCTCATGGGTTGACCCCGCAGCAGGTAGTTGCTATTGCTAGCAATGGTG

GCGGTCGTCCGGCCCTGGAGAGCATTGTGGCGCAGCTGAGCCGTCCAGACCCGGCGCTGGCGGC

TCTGACCAACGATCACCTGGTGGCGCTGGCTTGCCTGGGCGGTCGTCCGGCCCTGGATGCCGTG

AAGAAAGGCCTGGGT

Translated amino acid sequence:

(SEQ ID NO: 321)

DIADLRTLGYSQQQQEKIKPKVRSTVAQHHEALVGHGFTHAHIVALSQHPAALGTVAVKYQDMI

AALPEATHEAIVGVGKQWSGARALEALLTVAGELRGPPLQLDTGQLLKIAKRGGVTAVEAVHAW

RNALTGAPLNLTPQQVVAIASNNGGKQALETVQRLLPVLCQAHGLTPEQVVAIASHDGGKQALE

TVQRLLPVLCQAHGLTPQQVVAIASNGGGKQALETVQRLLPVLCQAHGLTPEQVVAIASNIGGK

QALETVQALLPVLCQAHGLTPQQVVAIASNNGGKQALETVQRLLPVLCQAHGLTPQQVVAIASN

NGGKQALETVQRLLPVLCQAHGLTPEQVVAIASHDGGKQALETVQRLLPVLCQAHGLTPQQVVA

IASNGGGKQALETVQRLLPVLCQAHGLTPQQVVAIASNNGGKQALETVQRLLPVLCQAHGLTPE

QVVAIASHDGGKQALETVQRLLPVLCQAHGLTPEQVVAIASHDGGKQALETVQRLLPVLCQAHG

LTPEQVVAIASNIGGKQALETVQALLPVLCQAHGLTPEQVVAIASNIGGKQALETVQALLPVLC

QAHGLTPQQVVAIASNGGGKQALETVQRLLPVLCQAHGLTPQQVVAIASNNGGKQALETVQRLL

PVLCQAHGLTPQQVVAIASNGGGRPALESIVAQLSRPDPALAALTNDHLVALACLGGRPALDAV

KKGLG

*(P) ND5.2-DdCBE Left mitoTALE repeat*

(SEQ ID NO: 322)

GACATCGCGGATCTGCGTACCCTGGGTTACAGCCAGCAGCAGCAGGAGAAGATCAAGCCGAAGG

TGCGCAGCACCGTGGCTCAGCACCACGAAGCCCTGGTGGGCCACGGTTTCACCCACGCTCACAT

TGTGGCCCTGAGCCAGCACCCAGCCGCGCTGGGCACCGTGGCCGTGAAATATCAGGATATGATT

GCTGCCCTGCCAGAGGCCACCCATGAAGCTATTGTGGGCGTGGGCAAGCAGTGGAGCGGTGCTC

GTGCGCTGGAGGCGCTGCTGACCGTGGCTGGTGAACTGCGTGGTCCGCCGCTGCAGCTGGACAC

CGGTCAGCTGCTGAAAATCGCGAAACGTGGCGGTGTGACCGCGGTGGAAGCCGTGCATGCTTGG

CGTAATGCTCTGACCGGTGCGCCGCTGAACCTGACCCCTGAGCAGGTGGTGGCAATCGCAAGCC

ACGACGGAGGCAAGCAGGCCCTGGAGACAGTGCAGGCCCTGCTGCCCGTGCTGTGCCAGGCACA

CGGCCTGACACCTGAGCAGGTGGTGGCCATCGCCTCCAACATCGGCGGCAAGCAGGCCCTGGAG

ACAGTACAGAGGCTGTTACCCGTGCTGTGCCAGGCCCACGGCCTGACACCCCAGCAGGTCGTCG

CCATCGCCTCTAATATTGGAGGCAAGCAGGCCCTGGAGACAGTCCAGCGCCTGCTGCCTGTGCT

GTGCCAGGCTCATGGCCTGACACCAGAACAGGTCGTGGCCATCGCCAGTAATATTGGGGGCAAG

CAGGCCCTGGAGACAGTTCAGGCCCTGTTACCCGTGCTGTGCCAAGCCCATGGCCTGACACCTG

AACAGGTGGTCGCCATCGCCTCCAATATTGGTGGCAAGCAGGCCCTGGAGACAGTACAGGCCCT

GCTGCCAGTGCTGTGCCAGGCTCACGGCCTGACACCAGAGCAGGTCGTCGCAATCGCATCTCAT

GATGGCGGCAAGCAGGCCCTGGAGACAGTACAGGCCCTGTTACCCGTGCTGTGCCAAGCGCACG

GCCTGACCCCTGAACAGGTCGTGGCTATTGCAAGCCACGATGGTGGCAAGCAGGCCCTGGAGAC

AGTACAGCGGCTGCTTCCCGTGCTGTGCCAAGCTCATGGCCTGACACCTGAGCAGGTCGTCGCT

ATTGCTAGCAATATTGGCGGCAAGCAGGCCCTGGAGACAGTACAGGCCCTGCTCCCCGTGCTGT

GCCAAGCACACGGCCTGACACCCGAACAGGTGGTGGCTATCGCCTCTAATGGAGGTGGCAAGCA

GGCCCTGGAGACAGTACAGAGGCTGCTTCCTGTGCTGTGCCAGGCCCATGGCCTGACCCCTGAG

CAGGTCGTGGCTATTGCCAGTAATATAGGAGGCAAGCAGGCCCTGGAGACAGTACAGGCCCTGC

TACCCGTGCTGTGCCAAGCGCATGGCCTGACCCCAGAACAGGTCGTGGCAATCGCATCTCATGA

-continued

CGGCGGCAAGCAGGCCCTGGAGACAGTACAGGCCCTGCTACCAGTGCTGTGCCAAGCACATGGC

CTGACCCCCGAACAGGTGGTGGCAATCGCCTCTCACGACGGGGGCAAGCAGGCCCTGGAGACAG

TACAGGCCCTGCTACCCGTGCTGTGCCAAGCGCACGGCCTGACGCCAGAACAGGTGGTCGCTAT

CGCAAGCAACGGCGGTGGCAAGCAGGCCCTGGAGACAGTACAGCGGCTGCTACCCGTGCTGTGC

CAAGCGCACGGCCTGACTCCTCAGCAGGTCGTCGCTATCGCATCTCATGATGGTGGCAAGCAGG

CCCTGGAGACAGTACAGCGGCTGCTACCCGTGCTGTGCCAAGCGCACGGCCTGACACCACAGCA

GGTCGTCGCAATTGCATCTAACGGAGGAGGCAGACCCGCCCTGGAGAGCATTGTGGCTCAGCTG

AGCCGTCCAGACCCGGCCCTGGCGGCTCTGACCAACGATCACCTGGTGGCGCTGGCTTGCCTGG

GCGGTCGTCCGGCCCTGGATGCGGTGAAGAAAGGCCTGGGT

Translated amino acid sequence:

(SEQ ID NO: 323)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLQLDTGQLLKIAKRGGVTAVEAVHAW

RNALTGAPLNLTPEQVVAIASHDGGKQALETVQALLPVLCQAHGLTPEQVVAIASNIGGKQALE

TVQRLLPVLCQAHGLTPQQVVAIASNIGGKQALETVORLLPVLCQAHGLTPEQVVAIASNIGGK

QALETVQALLPVLCQAHGLTPEQVVAIASNIGGKQALETVQALLPVLCQAHGLTPEQVVAIASH

DGGKQALETVQALLPVLCQAHGLTPEQVVAIASHDGGKQALETVORLLPVLCQAHGLTPEQVVA

IASNIGGKQALETVQALLPVLCQAHGLTPEQVVAIASNGGGKQALETVORLLPVLCQAHGLTPE

QVVAIASNIGGKQALETVQALLPVLCQAHGLTPEQVVAIASHDGGKQALETVQALLPVLCQAHG

LTPEQVVAIASHDGGKOALETVQALLPVLCQAHGLTPEQVVAIASNGGGKQALETVORLLPVLC

QAHGLTPQQVVAIASHDGGKQALETVORLLPVLCQAHGLTPQQVVAIASNGGGRPALESIVAQL

SRPDPALAALTNDHLVALACLGGRPALDAVKKGLG

*(Q) ND5.3-DdCBE Right mitoTALE repeat*

(SEQ ID NO: 324)

GACATCGCGGATCTGCGTACCCTGGGTTACAGCCAGCAGCAGCAGGAGAAGATCAAGCCAAAGG

TGCGCAGCACCGTGGCCCAGCACCATGAAGCTCTGGTGGGTCACGGCTTCACCCACGCGCACAT

CGTGGCTCTGAGCCAGCACCCAGCCGCGCTGGGTACCGTGGCCGTGAAATATCAGGACATGATT

GCTGCCCTGCCAGAGGCTACCCATGAAGCGATTGTGGGTGTGGGCAAGCAGTGGAGCGGTGCTC

GTGCGCTGGAGGCCCTGCTGACCGTGGCCGGTGAACTGCGTGGCCCGCCGCTGCAGCTGGATAC

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACACCACAGCAGGTCGTCGCTATCGCTTCAA

ACATTGGGGGGAAACAGGCACTGGAAACCGTCCAGAGACTGCTGCCCGTCCTGTGCCAGGCCCA

CGGCCTGACCCCTGAGCAGGTGGTGGCCATCGCCAGCAATATCGGAGGCAAGCAGGCCCTGGAG

ACCGTGCAGCGGCTGCTGCCCGTGCTGTGCCAAGCCCACGGCTTAACACCTCAGCAGGTCGTGG

CTATCGCCTCCAACAATGGCGGCAAGCAGGCCCTGGAGACGGTGCAGAGACTGCTGCCAGTGCT

GTGCCAGGCCCACGGCTTAACACCAGAACAGGTCGTGGCCATCGCCTCTAACATTGGCGGCAAG

CAGGCCCTGGAGACTGTGCAGGCCCTGCTGCCCGTGCTGTGCCAGGCCCACGGCCTTACACCAC

AGCAGGTGGTGGCAATCGCCAGCAATGGAGGGGGCAAGCAGGCCCTGGAGACAGTGCAGAGGCT

GCTGCCCGTGCTGTGCCAAGCCCACGGCCTGACACCTCAGCAGGTGGTCGCCATCGCCTCCAAC

GGAGGTGGCAAGCAGGCCCTGGAGACGGTACAGCGCCTGCTGCCCGTGCTGTGCCAAGCCCACG

GCCTAACACCCGAACAGGTCGTCGCCATCGCCTCTAACATCGGCGGCAAGCAGGCCCTGGAGAC

GGTCCAGCGGCTGCTGCCTGTGCTGTGCCAAGCCCACGGCCTTACCCCTCAGCAGGTCGTGGCA

-continued

ATCGCCAGCAACAATGGTGGCAAGCAGGCCCTGGAGACGGTTCAGAGACTGCTGCCCGTGCTGT
GCCAAGCCCACGGCCTCACACCTCAGCAGGTGGTGGCCATTGCCTCCAACGGAGGAGGCAAGCA
GGCCCTGGAGACGGTACAGAGGCTGCTGCCAGTGCTGTGCCAGGCCCACGGCCTAACACCAGAA
CAGGTGGTCGCTATTGCCTCTAACATTGGTGGCAAGCAGGCCCTGGAGACGGTACAGCGCCTGC
TGCCCGTGCTGTGCCAAGCCCACGGCCTAACGCCAGAACAGGTCGTCGCTATCGCCAGCAACGG
AGGAGGCAAGCAGGCCCTGGAGACGGTACAGCGGCTGCTGCCCGTGCTGTGCCAAGCCCACGGC
CTAACCCCACAGCAGGTCGTGGCCATTGCCTCCAATAACGGCGGCAAGCAGGCCCTGGAGACGG
TACAGCGGCTGCTGCCCGTGCTGTGCCAAGCCCACGGCCTAACTCCCCAGCAAGTCGTCGCTAT
TGCCTCTAATAACGGGGGCAAGCAGGCCCTGGAGACGGTACAGAGACTGCTGCCCGTGCTGTGC
CAAGCCCACGGCCTGACACCACAGCAGGTCGTCGCCATCGCAAGCAACGGAGGAGGGAGGCCCG
CACTGGAGAGCATTGTGGCGCAGCTGAGCCGTCCAGACCCGGCCCTGGCGGCTCTGACCAATGA
TCACCTGGTGGCCCTGGCCTGCCTGGGTGGCCGTCCGGCTCTGGATGCCGTGAAGAAAGGTCTG
GGC

Translated amino acid sequence:

(SEQ ID NO: 325)

DIADLRTLGYSQQQQEKIKPKVRSTVAQHHEALVGHGFTHAHIVALSQHPAALGTVAVKYQDMI
AALPEATHEAIVGVGKOWSGARALEALLTVAGELRGPPLOLDTGOLLKIAKRGGVTAVEAVHAW
RNALTGAPLNLTPQQVVAIASNIGGKQALETVORLLPVLCQAHGLTPEQVVAIASNIGGKQALE
TVQRLLPVLCQAHGLTPQQVVAIASNNGGKQALETVORLLPVLCQAHGLTPEQVVAIASNIGGK
QALETVQALLPVLCQAHGLTPQQVVAIASNGGGKQALETVORLLPVLCQAHGLTPQQVVAIASN
GGGKQALETVQRLLPVLCQAHGLTPEQVVAIASNIGGKQALETVORLLPVLCQAHGLTPQQVVA
IASNNGGKQALETVORLLPVLCQAHGLTPQQVVAIASNGGGKQALETVORLLPVLCQAHGLTPE
QVVAIASNIGGKQALETVORLLPVLCQAHGLTPEQVVAIASNGGGKQALETVORLLPVLCQAHG
LTPQQVVAIASNNGGKQALETVORLLPVLCQAHGLTPQQVVAIASNNGGKQALETVORLLPVLC
QAHGLTPQQVVAIASNGGGRPALESIVAQLSRPDPALAALINDHLVALACLGGRPALDAVKKGL
G (*R*) *ND5.3-DdCBE Left mitoTALE repeat*

(SEQ ID NO: 326)

GACATCGCGGATCTGCGTACCCTGGGTTACAGCCAGCAGCAGCAGGAGAAGATCAAGCCGAAGG
TGCGCAGCACCGTGGCTCAGCACCACGAAGCCCTGGTGGGCCACGGTTTCACCCACGCTCACAT
TGTGGCCCTGAGCCAGCACCCAGCCGCGCTGGGCACCGTGGCCGTGAAATATCAGGATATGATT
GCTGCCCTGCCAGAGGCCACCCATGAAGCTATTGTGGGCGTGGGCAAGCAGTGGAGCGGTGCTC
GTGCGCTGGAGGCGCTGCTGACCGTGGCTGGTGAACTGCGTGGTCCGCCGCTGCAGCTGGACAC
CGGTCAGCTGCTGAAAATCGCGAAACGTGGCGGTGTGACCGCGGTGGAAGCCGTGCATGCTTGG
CGTAATGCTCTGACCGGTGCGCCGCTGAACCTGACTCCCGAACAGGTGGTCGCTATCGCTTCTC
ATGATGGCGGAAAACAGGCTCTGGAAACCGTCCAGGCTCTGCTGCCCGTGCTGTGCCAGGCCCA
CGGCCTGACCCCACAGCAGGTCGTCGCAATCGCCAGCAATATCGGAGGCAAGCAGGCCCTGGAG
ACCGTGCAGCGGCTGCTGCCCGTGCTGTGCCAAGCCCACGGCTTAACACCTCAGCAGGTGGTGG
CCATCGCCTCCAACAATGGCGGCAAGCAGGCCCTGGAGACGGTGCAGAGACTGCTGCCAGTGCT
GTGCCAGGCCCACGGCTTAACACCAGAACAGGTCGTGGCAATCGCCTCTAACGGAGGGGGCAAG
CAGGCCCTGGAGACTGTGCAGGCCCTGCTGCCCGTGCTGTGCCAGGCCCACGGCCTTACACCAG
AACAGGTGGTCGCCATTGCCAGCAATGGAGGTGGCAAGCAGGCCCTGGAGACAGTCCAGGCCCT
GCTGCCCGTGCTGTGCCAAGCCCACGGCCTGACACCTGAACAGGTGGTCGCAATCGCCTCCCAC

-continued

GATGGGGGCAAGCAGGCCCTGGAGACGGTACAGGCCCTGCTGCCCGTGCTGTGCCAAGCCCACG

GCCTAACACCCGAACAGGTGGTGGCCATTGCCTCTAACGGAGGAGGCAAGCAGGCCCTGGAGAC

GGTCCAGCGGCTGCTGCCTGTGCTGTGCCAAGCCCACGGCCTTACCCCTGAACAAGTCGTGGCC

ATCGCCAGCAATGGAGGAGGCAAGCAGGCCCTGGAGACGGTTCAGGCCCTGCTGCCCGTGCTGT

GCCAAGCCCACGGCCTCACACCTGAACAAGTIGTGGCCATCGCCTCCCACGATGGTGGCAAGCA

GGCCCTGGAGACGGTACAGAGGCTGCTGCCAGTGCTGTGCCAGGCCCACGGCCTAACACCAGAA

CAGGTGGTGGCTATCGCCTCTAACATTGGCGGCAAGCAGGCCCTGGAGACGGTACAGGCCCTGC

TGCCCGTGCTGTGCCAAGCCCACGGCCTAACGCCAGAACAGGTCGTCGCTATTGCCAGCAACAT

TGGGGGCAAGCAGGCCCTGGAGACGGTACAGGCCCTGCTGCCCGTGCTGTGCCAAGCCCACGGC

CTAACCCCTGAACAGGTGGTGGCAATCGCCTCCAACATTGGTGGCAAGCAGGCCCTGGAGACGG

TACAGGCCCTGCTGCCCGTGCTGTGCCAAGCCCACGGCCTAACTCCCGAGCAGGTCGTCGCCAT

CGCCTCTAATGGCGGCGGCAAGCAGGCCCTGGAGACGGTACAGAGGCTGCTGCCTGTGCTGTGC

CAAGCCCACGGCCTAACGCCGCAGCAAGTCGTCGCTATTGCCAGCAATATTGGCGGCAAGCAGG

CCCTGGAGACGGTACAGCGCCTGCTGCCCGTGCTGTGCCAAGCCCACGGCCTGACCCCCCAGCA

GGTGGTGGCAATCGCTTCAAACGGAGGAGGGAGACCCGCTCTGGAAAGCATTGTGGCTCAGCTG

AGCCGTCCAGACCCGGCCCTGGCGGCTCTGACCAACGATCACCTGGTGGCGCTGGCTTGCCTGG

GCGGTCGTCCGGCCCTGGATGCGGTGAAGAAAGGCCTGGGT

Translated amino acid sequence:

(SEQ ID NO: 327)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGQLLKIAKRGGVTAVEAVHAW

RNALTGAPLNLTPEQVVAIASHDGGKQALETVQALLPVLCQAHGLTPQQVVAIASNIGGKQALE

TVQRLLPVLCQAHGLTPQQVVAIASNNGGKQALETVORLLPVLCQAHGLTPEQVVAIASNGGGK

QALETVQALLPVLCQAHGLTPEQVVAIASNGGGKQALETVQALLPVLCQAHGLTPEQVVAIASH

DGGKQALETVQALLPVLCQAHGLTPEQVVAIASNGGGKQALETVORLLPVLCQAHGLTPEQVVA

IASNGGGKQALETVQALLPVLCQAHGLTPEQVVAIASHDGGKQALETVQRLLPVLCQAHGLTPE

QVVAIASNIGGKQALETVQALLPVLCQAHGLTPEQVVAIASNIGGKQALETVQALLPVLCQAHG

LTPEQVVAIASNIGGKQALETVOALLPVLCQAHGLTPEQVVAIASNGGGKQALETVQRLLPVLC

QAHGLTPQQVVAIASNIGGKQALETVORLLPVLCQAHGLTPQQVVAIASNGGGRPALESIVAQL

SRPDPALAALTNDHLVALACLGGRPALDAVKKGLG (*S*) *ATP8-DdCBE Right mitoTALE repeat*

(SEQ ID NO: 328)

GACATCGCGGATCTGCGTACCCTGGGTTACAGCCAGCAGCAGCAGGAGAAGATCAAGCCAAAGG

TGCGCAGCACCGTGGCCCAGCACCATGAAGCTCTGGTGGGTCACGGCTTCACCCACGCGCACAT

CGTGGCTCTGAGCCAGCACCCAGCCGCGCTGGGTACCGTGGCCGTGAAATATCAGGACATGATT

GCTGCCCTGCCAGAGGCTACCCATGAAGCGATTGTGGGTGTGGGCAAGCAGTGGAGCGGTGCTC

GTGCGCTGGAGGCCCTGCTGACCGTGGCCGGTGAACTGCGTGGCCCGCCGCTGCAGCTGGATAC

CGGCCAGCTGCTGAAAATCGCGAAACGTGGCGGTGTGACCGCTGTGGAAGCTGTGCATGCCTGG

CGTAATGCTCTGACCGGTGCCCCGCTGAACCTGACCCCTCAGCAGGTGGTGGCCATCGCCAGCA

ACATCGGCGGCAAGCAGGCCCTGGAGACAGTGCAGAGGCTGCTGCCCGTGCTGTGCCAGGCACA

CGGCCTGACACCTGAGCAGGTGGTGGCAATCGCATCCAATGGAGGAGGCAAGCAGGCCCTGGAG

ACAGTACAGCGCCTGTTACCCGTGCTGTGCCAGGCCCACGGCCTGACACCCCAGCAGGTCGTCG

-continued

CCATCGCCTCTAACAATGGGGGCAAGCAGGCCCTGGAGACAGTCCAGCGGCTGCTGCCTGTGCT
GTGCCAGGCTCATGGCCTGACACCAGAACAGGTCGTGGCTATTGCCAGCAACAATGGTGGCAAG
CAGGCCCTGGAGACAGTTCAGGCCCTGCTTCCCGTGCTGTGCCAGGCTCACGGCCTGACACCAC
AGCAGGTCGTGGCCATCGCCTCCAACAATGGCGGCAAGCAGGCCCTGGAGACAGTACAGAGACT
GCTGCCAGTGCTGTGCCAAGCCCATGGCCTGACCCCTCAGCAGGTCGTGGCAATCGCATCTCAC
GACGGTGGCAAGCAGGCCCTGGAGACAGTACAGAGGCTGTTACCCGTGCTGTGCCAAGCACACG
GCCTGACACCAGAGCAGGTCGTCGCAATCGCAAGCAACGGCGGCGGCAAGCAGGCCCTGGAGAC
AGTACAGCGCCTGCTCCCCGTGCTGTGCCAAGCCCACGGCCTGACACCTCAGCAGGTGGTCGCC
ATTGCCAGCAACGGCGGGGGCAAGCAGGCCCTGGAGACAGTACAGCGGCTGTTGCCCGTGCTGT
GCCAAGCCCACGGCCTGACGCCCCAGCAGGTGGTCGCCATCGCATCTAACGGCGGTGGCAAGCA
GGCCCTGGAGACAGTACAGCGGCTGCTTCCTGTGCTGTGCCAGGCCCATGGCCTGACCCCCGAA
CAGGTCGTGGCTATCGCTAGCAACAATGGCGGCAAGCAGGCCCTGGAGACAGTACAGAGACTGT
TACCCGTGCTGTGCCAAGCGCATGGCCTGACCCCTGAACAGGTCGTGGCAATTGCCTCCAATAA
CGGTGGCAAGCAGGCCCTGGAGACAGTACAGCGGCTGCTACCAGTGCTGTGCCAAGCACATGGC
CTGACCCCCCAGCAGGTCGTGGCTATTGCATCTAATGGAGGAGGCAGACCCGCCCTGGAGAGCA
TTGTGGCGCAGCTGAGCCGTCCAGACCCGGCCCTGGCGGCTCTGACCAATGATCACCTGGTGGC
CCTGGCCTGCCTGGGTGGCCGTCCGGCTCTGGATGCCGTGAAGAAAGGTCTGGGC

Translated amino acid sequence:

(SEQ ID NO: 329)

DIADLRTLGYSQQQQEKIKPKVRSTVAQHHEALVGHGFTHAHIVALSQHPAALGTVAVKYQDMI
AALPEATHEAIVGVGKOWSGARALEALLTVAGELRGPPLOLDTGQLLKIAKRGGVTAVEAVHAW
RNALTGAPLNLTPQQVVAIASNIGGKQALETVORLLPVLCQAHGLTPEQVVAIASNGGGKQALE
TVQRLLPVLCQAHGLTPQQVVAIASNNGGKQALETVORLLPVLCQAHGLTPEQVVAIASNNGGK
QALETVQALLPVLCQAHGLTPQQVVAIASNNGGKQALETVORLLPVLCQAHGLTPQQVVAIASH
DGGKQALETVORLLPVLCQAHGLTPEQVVAIASNGGGKQALETVORLLPVLCQAHGLTPQQVVA
IASNGGGKQALETVORLLPVLCQAHGLTPQQVVAIASNGGGKQALETVORLLPVLCQAHGLTPE
QVVAIASNNGGKQALETVORLLPVLCQAHGLTPEQVVAIASNNGGKQALETVORLLPVLCQAHG
LTPQQVVAIASNGGGRPALESIVAQLSRPDPALAALTNDHLVALACLGGRPALDAVKKGLG

*(T) ATP8-DdCBE Left mitoTALE repeat*

(SEQ ID NO: 330)

GACATCGCGGATCTGCGTACCCTGGGTTACAGCCAGCAGCAGCAGGAGAAGATCAAGCCGAAGG
TGCGCAGCACCGTGGCTCAGCACCACGAAGCCCTGGTGGGCCACGGTTTCACCCACGCTCACAT
CGTGGCCCTGAGCCAGCACCCAGCCGCGCTGGGCACCGTGGCCGTGAAATATCAGGACATGATT
GCTGCCCTGCCAGAGGCCACCCATGAAGCTATTGTGGGCGTGGGCAAGCAGTGGAGCGGTGCTC
GTGCGCTGGAGGCGCTGCTGACCGTGGCTGGTGAACTGCGTGGTCCGCCGCTGCAGCTGGATAC
CGGTCAGCTGCTGAAAATCGCGAAACGTGGCGGTGTGACCGCGGTGGAAGCCGTGCATGCTTGG
CGTAATGCTCTGACCGGTGCGCCGCTGAACCTGACCCCGGAGCAGGTGGTGGCTATCGCCAGCA
ACATTGGCGGTAAACAGGCCCTGGAAACCGTGCAGGCGCTGCTGCCGGTGCTGTGCCAGGCTCA
TGGTCTGACCCCGCAGCAGGTGGTGGCGATCGCTAGCAACGGCGGTGGCAAGCAGGCTCTGGAG
ACCGTGCAGCGTCTGTTACCGGTGCTGTGCCAAGCCCATGGCCTGACCCCGCAGCAAGTIGTGG
CCATTGCGAGCAATGGTGGCGGTAAACAGGCGCTGGAAACCGTGCAGCGCCTGTTGCCGGTGCT
GTGCCAAGCCCATGGGCTGACCCCGGAACAAGTTGTTGCTATCGCCAGCAACATCGGCGGCAAG
CAGGCTCTGGAAACCGTGCAGGCCCTGCTTCCGGTGCTGTGCCAAGCGCATGGTCTGACCCCGG

-continued

AACAAGTGGTGGCCATCGCTTCCAATATTGGCGGTAAACAGGCGCTGGAGACCGTGCAGGCTCT

GCTCCCGGTGCTGTGCCAAGCACATGGTCTGACCCCGGAGCAAGTIGTGGCTATTGCCTCCAAT

ATCGGCGGCAAGCAGGCCCTGGAGACCGTTCAGGCGCTGTTACCGGTGCTGTGCCAGGCCCATG

GATTAACCCCGGAGCAAGTGGTGGCTATTGCTAGCCATGATGGCGGTAAACAGGCCCTGGAGAC

TGTTCAGCGTCTGCTACCGGTGCTGTGCCAGGCCCATGGTTTAACCCCGGAACAGGTTGTTGCC

ATCGCTTCCAACATCGGCGGCAAGCAGGCTCTGGAAACGGTGCAGGCCCTGTTACCGGTGCTGT

GCCAGGCCCATGGGTTAACCCCGGAACAAGTTGTGGCCATTGCCTCCCATGACGGCGGTAAACA

GGCTCTGGAGACCGTTCAGCGCCTGCTACCGGTGCTGTGCCAGGCGCATGGCTTAACCCCGGAA

CAAGTGGTTGCCATTGCGTCCAATATCGGCGGCAAGCAGGCGCTGGAGACCGTTCAGGCTCTGC

TTCCGGTGCTGTGCCAGGCACATGGCCTTACCCCGGAACAAGTGGTCGCGATCGCTTCCAACAT

TGGCGGTAAACAGGCCCTGGAAACGGTTCAGGCGCTGCTTCCGGTGCTGTGCCAGGCCCATGGG

CTTACCCCGGAACAGGTTGTGGCTATTGCCAGTAATATCGGCGGCAAGCAGGCTCTGGAAACTG

TGCAGGCCCTGCTACCGGTGCTGTGCCAGGCTCATGGGCTGACCCCGGAGCAAGTGGTTGCCAT

TGCCTCCCATGATGGCGGTAAACAGGCGCTGGAAACGGTGCAGCGTCTGCTTCCGGTGCTGTGC

CAGGCTCATGGCTTAACCCCGCAGCAAGTTGTTGCGATTGCTAGCAATGGCGGTGGCAAGCAGG

CCCTGGAAACTGTTCAGCGCCTGTTACCGGTGCTGTGCCAGGCCCATGGGCTAACCCCGGAACA

GGTGGTTGCTATTGCCAGCAACATTGGTGGCAAACAGGCGCTGGAAACTGTGCAGGCTCTGCTT

CCGGTGCTGTGCCAGGCCCATGGGCTGACCCCGCAGCAAGTGGTTGCTATTGCTAGCAATGGTG

GCGGTCGTCCGGCCCTGGAGAGCATTGTGGCGCAGCTGAGCCGTCCAGACCCGGCCCTGGCGGC

TCTGACCAACGATCACCTGGTGGCGCTGGCTTGCCTGGGCGGTCGTCCGGCCCTGGATGCGGTG

AAGAAAGGCCTGGGT

Translated amino acid sequence:

(SEQ ID NO: 331)

DIADLRTLGYSQQQQEKIKPKVRSTVAQHHEALVGHGFTHAHIVALSQHPAALGTVAVKYQDMI

AALPEATHEAIVGVGKOWSGARALEALLTVAGELRGPPLOLDTGOLLKIAKRGGVTAVEAVHAW

RNALTGAPLNLTPEQVVAIASNIGGKQALETVQALLPVLCQAHGLTPQQVVAIASNGGGKQALE

TVQRLLPVLCQAHGLTPQQVVAIASNGGGKQALETVORLLPVLCQAHGLTPEQVVAIASNIGGK

QALETVQALLPVLCQAHGLTPEQVVAIASNIGGKQALETVQALLPVLCQAHGLTPEQVVAIASN

IGGKQALETVQALLPVLCQAHGLTPEQVVAIASHDGGKOALETVORLLPVLCQAHGLTPEQVVA

IASNIGGKQALETVQALLPVLCQAHGLTPEQVVAIASHDGGKQALETVORLLPVLCQAHGLTPE

QVVAIASNIGGKQALETVQALLPVLCQAHGLTPEQVVAIASNIGGKQALETVQALLPVLCQAHG

LTPEQVVAIASNIGGKQALETVQALLPVLCQAHGLTPEQVVAIASHDGGKQALETVQRLLPVLC

QAHGLTPQQVVAIASNGGGKQALETVORLLPVLCQAHGLTPEQVVAIASNIGGKQALETVQALL

PVLCQAHGLTPQQVVAIASNGGGRPALESIVAQLSRPDPALAALTNDHLVALACLGGRPALDAV

KKGLG

Intact DddAtox-Cas9 fusions sequences
All intact DddAtox-Cas9 have the general architecture of (from N- to C-terminus): bpNLS-DddAtox-linker 1-dSpCas9 or SpCas9(D10A)-10aa linker--10aa linker- UGI-4aa linker-bpNLS

DddAtox

(SEQ IN NO: 338)

GSYALGPYQISAPOLPAYNGQTVGTFYYVNDAGGLESKVFSSGGPTPYPNYANAGHVEGQSALF

MRDNGISEGLVFHNNPEGTCGFCVNMTETLLPENAKMTVVPPEGAIPVKRGATGETKVFTGNSN

SPKSPTKGGC

-continued dSpCas9

(SEQ ID NO: 339)

DKKYSIGLAIGTNSVGWAVITDEYKVPSKKFKVLGNTDRHSIKKNLIGALLFDSGETAEATRLK

RTARRRYTRRKNRICYLQEIFSNEMAKVDDSFFHRLEESFLVEEDKKHERHPIFGNIVDEVAYH

EKYPTIYHLRKKLVDSTDKADLRLIYLALAHMIKFRGHFLIEGDLNPDNSDVDKLFIQLVQTYN

QLFEENPINASGVDAKAILSARLSKSRRLENLIAQLPGEKKNGLFGNLIALSLGLTPNFKSNED

LAEDAKLQLSKDTYDDDLDNLLAQIGDQYADLFLAAKNLSDAILLSDILRVNTEITKAPLSASM

IKRYDEHHQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFDKNLPNEKVLPKHSL

LYEYFTVYNELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERLKTYAH

LFDDKVMKQLKRRRYTGWGRLSRKLINGIRDKQSGKTILDFLKSDGFANRNFMQLIHDDSLTFK

EDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD

SpCas9 (D10A)

(SEQ ID NO: 340)

DKKYSIGLAIGTNSVGWAVITDEYKVPSKKFKVLGNTDRHSIKKNLIGALLFDSGETAEATRLK

RTARRRYTRRKNRICYLQEIFSNEMAKVDDSFFHRLEESFLVEEDKKHERHPIFGNIVDEVAYH

EKYPTIYHLRKKLVDSTDKADLRLIYLALAHMIKFRGHFLIEGDLNPDNSDVDKLFIQLVQTYN

QLFEENPINASGVDAKAILSARLSKSRRLENLIAQLPGEKKNGLFGNLIALSLGLTPNFKSNED

LAEDAKLQLSKDTYDDDLDNLLAQIGDQYADLFLAAKNLSDAILLSDILRVNTEITKAPLSASM

IKRYDEHHQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFDKNLPNEKVLPKHSL

LYEYFTVYNELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERLKTYAH

LFDDKVMKQLKRRRYTGWGRLSRKLINGIRDKQSGKTILDFLKSDGFANRNFMQLIHDDSLTFK

EDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

-continued

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKOLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD

UGI

(SEQ ID NO: 341)

TNLSDIIEKETGKOLVIQESILMLPEEVEEVIGNKPESDILVHTAYDESTDENVMLLTSDAPEY

KPWALVIQDSNGENKIKML bpNLS

(SEQ ID NO: 342)

KRTADGSEFEPKKKRKV

Linker 1: 32aa linker

(SEQ ID NO: 343)

SGGSSGGSSGSETPGTSESATPESSGGSSGGS

Linker 1: 10aa flexible

(SEQ ID NO: 344)

GGGGSGGGGS

Linker 1: 10aa rigid

(SEQ ID NO: 345)

EAAAKEAAAK

Linker 1: 5aa rigid

(SEQ ID NO: 346)

EAAAK

10aa linker

(SEQ ID NO: 347)

SGGSGGSGGS

4aa linker

(SEQ ID NO: 348)

SGGS

Supplementary Sequences 21 Split-DddA$_{tox}$-Cas9 Fusions Sequences

All split-DddA$_{tox}$-Cas9 have the general architecture of (from N- to C-terminus): bpNLS-DddA$_{tox}$ half-32aa linker-dSpCas9 or SaKKH-Cas9(D10A)-10aa linker-UGI-10aa linker-UGI-4aa linker-bpNLS G1333 DddAtox-N (SEQ ID NO: 349)

GSYALGPYQISAPQLPAYNGQTVGTFYYVNDAGGLESKVFSSGG

G1333 DddAtox-C (SEQ ID NO: 350)

PTPYPNYANAGHVEGQSALFMRDNGISEGLVFHNNPEGTCGFCVNMTETLLPENAKMT
VVPPEGAIPVKRGATGETKVFTGNSNSPKSPTKGGC

G1397 DddAtox-N (SEQ ID NO: 351)

GSYALGPYQISAPQLPAYNGQTVGTFYYVNDAGGLESKVESSGGPTPYPNYANAGHVE
GQSALFMRDNGISEGLVFHNNPEGTCGFCVNMTETLLPENAKMTVVPPEG

G1397 DddAtox-C (SEQ ID NO: 352)

AIPVKRGATGETKVFTGNSNSPKSPTKGGC dSpCas9

(SEQ ID NO: 353)

DKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDN

-continued

SDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRFNASLGT

YHDLLKIIKDKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQE

LDINRLSDYDVDAIVPQSFLKDDSIDNKVLTRSDKNRGKSDNVPSEEVVKKMKNYWRQ

LLNAKLITQRKFDNLTKAERGGLSELDKAGFIKRQLVETRQITKHVAQILDSRMNTKYD

ENDKLIREVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLANGEIRKRP

LIETNGETGEIVWDKGRDFATVRKVLSMPQVNIVKKTEVQTGGFSKESILPKRNSDKLI

ARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLY

LASHYEKLKGSPEDNEQKQLFVEQHKHYLDEIIEQISEFSKRVILADANLDKVLSAYNK

HRDKPIREQAENIIHLFTLTNLGAPAAFKYFDTTIDRKRYTSTKEVLDATLIHQSITGLYE

TRIDLSQLGGD

SaKKH-Cas9(D10A)

(SEQ ID NO: 354)

GKRNYILGLAIGITSVGYGIIDYETRDVIDAGVRLFKEANVENNEGRRSKRGARRLKRR

RRHRIQRVKKLLFDYNLLTDHSELSGINPYEARVKGLSQKLSEEEFSAALLHLAKRRGV

HNVNEVEEDTGNELSTKEQISRNSKALEEKYVAELQLERLKKDGEVRGSINRFKTSDYV

KEAKQLLKVQKAYHQLDQSFIDTYIDLLETRRTYYEGPGEGSPFGWKDIKEWYEMLM

GHCTYFPEELRSVKYAYNADLYNALNDLNNLVITRDENEKLEYYEKFQIIENVFKQKK

KPTLKQIAKEILVNEEDIKGYRVTSTGKPEFTNLKVYHDIKDITARKEIIENAELLDQIAKI

LTIYQSSEDIQEELTNLNSELTQEEIEQISNLKGYTGTHNLSLKAINLILDELWHTNDNQI

AIFNRLKLVPKKVDLSQQKEIPTTLVDDFILSPVVKRSFIQSIKVINAIIKKYGLPNDIIIEL

AREKNSKDAQKMINEMQKRNRQTNERIEEIIRTTGKENAKYLIEKIKLHDMQEGKCLYS

LEAIPLEDLLNNPFNYEVDHIIPRSVSFDNSFNNKVLVKQEENSKKGNRTPFQYLSSSDS

KISYETFKKHILNLAKGKGRISKTKKEYLLEERDINRFSVQKDFINRNLVDTRYATRGL

MNLLRSYFRVNNLDVKVKSINGGFTSFLRRKWKFKKERNKGYKHHAEDALIIANADFI

FKEWKKLDKAKKVMENQMFEEKQAESMPEIETEQEYKEIFITPHQIKHIKDFKDYKYSH

RVDKKPNRKLINDTLYSTRKDDKGNTLIVNNLNGLYDKDNDKLKKLINKSPEKLLMYH

HDPQTYQKLKLIMEQYGDEKNPLYKYYEETGNYLTKYSKKDNGPVIKKIKYYGNKLN

AHLDITDDYPNSRNKVVKLSLKPYRFDVYLDNGVYKFVTVKNLDVIKKENYYEVNSK

-continued

CYEEAKKLKKISNQAEFIASFYKNDLIKINGELYRVIGVNNDLLNRIEVNMIDITYREYL

ENMNDKRPPHIIKTIASKTQSIKKYSTDILGNLYEVKSKKHPQIIKKGGSPKKKRKVSSD

YKDHDGDYKDHDIDYKDDDDK

UGI (SEQ ID NO: 355)
TNLSDIIEKETGKQLVIQESILMLPEEVEEVIGNKPESDILVHTAYDESTDENVMLLTSDA
PEYKPWALVIQDSNGENKIKML bpNLS (SEQ ID NO: 356)
KRTADGSEFEPKKKRKV 32 aa linker (SEQ ID NO: 357)
SGGSSGGSSGSETPGTSESATPESSGGSSGGS 10 aa linker (SEQ ID NO: 358)
SGGSGGSGGS 4 aa linker (SEQ ID NO: 359)
SGGS Supplementary Sequences 4| General DdCBE Architecture and mitoTALE Amino Acid Sequences All right-side halves of DdCBEs have the general architecture of (from N- to C-terminus): COX8A MTS-3xFLAG-mitoTALE-2aa linker-DddA$_{tox}$ half-4aa linker-1x-UGI-ATP5B 3'UTR All left-side halves of DdCBEs have the general architecture of (from N- to C-terminus): SOD2 MTS-3xHA-mitoTALE-2aa linker-DddA$_{tox}$ half-4aa linker-1x-UGI-SOD2 3'UTR mitoTALE domains are annotated as: bold for N-terminal domain, underlined for RVD and bolded italics for C-terminal domain.

ND6-DdCBE: Left mitoTALE-G1397-DddAtox-N-1x-UGI (Note: Terminal NG RVD recognizes a mismatched T instead of a G in the reference genome)

(SEQ ID NO: 360)
MALSRAVCGTSRQLAPVLGYLGSRQKHSLPDYPYDVPDYAGYPYDVPDYAGYPYDVP

DYAMDIADLRTLGYSQQQQEKIKPKVRSTVAQHHEALVGHGFTHAHIVALSQHPAAL

GTVAVKYQDMIAALPEATHEAIVGVGKQWSGARALEALLTVAGELRGPPLQLDTGQL

LKIAKRGGVTAVEAVHAWRNALTGAPLNLTPQQVVAIASNNGGKQALETVQRLLPVL

CQAHGLTPEQVVAIASNIGGKQALETVQALLPVLCQAHGLTPEQVVAIASHDGGKQAL

ETVQRLLPVLCQAHGLTPEQVVAIASHDGGKQALETVQRLLPVLCQAHGLTPEQVVAI

ASHDGGKQALETVQRLLPVLCQAHGLTPEQVVAIASHDGGKQALETVQRLLPVLCQA

HGLTPEQVVAIASHDGGKQALETVQRLLPVLCQAHGLTPEQVVAIASNIGGKQALETV

QALLPVLCQAHGLTPQQVVAIASNGGGKQALETVQRLLPVLCQAHGLTPQQVVAIASN

GGGRPALESIVAQLSRPDPALAALTNDHLVALACLGGRPALDAVKKGLGGSGSYALGP

YQISAPQLPAYNGQTVGTFYYVNDAGGLESKVFSSGGPTPYPNYANAGHVEGQSALFM

RDNGISEGLVFHNNPEGTCGFCVNMTETLLPENAKMTVVPPEGSGGSTNLSDIIEKETG

KQLVIQESILMLPEEVEEVIGNKPESDILVHTAYDESTDENVMLLTSDAPEYKPWALVIQ

DSNGENKIKML**

ND6-DdCBE: Right mitoTALE-G1397-DddAtox-N-1x-UGI (Note: Terminal NG RVD recognizes a mismatched T instead of a G in the reference genome. The NTD was also engineered to be permissive for A, T, C and G nucleotides at the NO position)

(SEQ ID NO: 361)
MASVLTPLLLRGLTGSARRLPVPRAKIHSLDYKDHDGDYKDHDIDYKDDDDKMDIAD

LRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGV

-continued

TAVEAVHAWRNALTGAPLNLTPQQVVAIASNNGGKQALETVQRLLPVLCQAHGLTPE
QVVAIASNIGGKQALETVQALLPVLCQAHGLTPQQVVAIASNGGGKQALETVQRLLPV
LCQAHGLTPQQVVAIASNNGGKQALETVQRLLPVLCQAHGLTPQQVVAIASNNGGKQ
ALETVQRLLPVLCQAHGLTPEQVVAIASHDGGKQALETVQRLLPVLCQAHGLTPQQVV
AIASNGGGKQALETVQRLLPVLCQAHGLTPEQVVAIASNIGGKQALETVQALLPVLCQ
AHGLTPQQVVAIASNGGGKQALETVQRLLPVLCQAHGLTPQQVVAIASNGGGKQALE
TVQRLLPVLCQAHGLTPQQVVAIASNGGGRPALESIVAQLSRPDPALAALTNDHLVAL
ACLGGRPALDAVKKGLGGSAIPVKRGATGETKVFTGNSNSPKSPTKGGCSGGSTNLSDI
IEKETGKQLVIQESILMLPEEVEEVIGNKPESDILVHTAYDESTDENVMLLTSDAPEYKP
WALVIQDSNGENKIKML**

ND1-DdCBE Right mitoTALE repeat (SEQ ID NO: 362)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNNGGKQALETVQALLPVLCQAHGL
TPQQVVAIASNIGGKQALETVQRLLPVLCQAHGLTPQQVVAIASNNGGKQALETVQRL
LPVLCQAHGLTPEQVVAIASNGGGKQALETVQALLPVLCQAHGLTPEQVVAIASNGGG
KQALETVQALLPVLCQAHGLTPEQVVAIASNGGGKQALETVQALLPVLCQAHGLTPEQ
VVAIASNNGGKQALETVQRLLPVLCQAHGLTPEQVVAIASNIGGKQALETVQALLPVL
CQAHGLTPEQVVAIASNGGGKQALETVQRLLPVLCQAHGLTPEQVVAIASNNGGKQA
LETVQALLPVLCQAHGLTPEQVVAIASHDGGKQALETVQALLPVLCQAHGLTPEQVVA
IASNGGGKQALETVQALLPVLCQAHGLTPEQVVAIASHDGGKQALETVQRLLPVLCQA
HGLTPQQVVAIASNIGGKQALETVQRLLPVLCQAHGLTPEQVVAIASHDGGKQALETV
QALLPVLCQAHGLTPQQVVAIASHDGGKQALETVQRLLPVLCQAHGLTPQQVVAIASH
DGGKQALETVQRLLPVLCQAHGLTPQQVVAIASNGGGRPALESIVAQLSRPDPALAAL
TNDHLVALACLGGRPALDAVKKGLG

ND1-DdCBE Left mitoTALE repeat (SEQ ID NO: 363)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNGGGKQALETVQRLLPVLCQAHGLTPQQVVAIASNIGGKQALETVQRL
LPVLCQAHGLTPEQVVAIASNNGGKQALETVQALLPVLCQAHGLTPEQVVAIASHDGG
KQALETVQALLPVLCQAHGLTPEQVVAIASHDGGKQALETVQALLPVLCQAHGLTPEQ
VVAIASNGGGKQALETVQRLLPVLCQAHGLTPEQVVAIASNIGGKQALETVQALLPVL
CQAHGLTPEQVVAIASNNGGKQALETVQRLLPVLCQAHGLTPEQVVAIASHDGGKQA
LETVQALLPVLCQAHGLTPEQVVAIASHDGGKQALETVQALLPVLCQAHGLTPEQVVA
IASNNGGKQALETVQALLPVLCQAHGLTPEQVVAIASNGGGKQALETVQRLLPVLCQA
HGLTPQQVVAIASNGGGKQALETVQRLLPVLCQAHGLTPQQVVAIASNGGGRPALESI
VAQLSRPDPALAALTNDHLVALACLGGRPALDAVKKGLG

-continued

ND2-DdCBE Right mitoTALE repeat (SEQ ID NO: 364)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASNIGGKQALETVQALLPVLCQAHGL
TPQQVVAIASNNGGKQALETVQRLLPVLCQAHGLTPQQVVAIASNIGGKQALETVQRL
LPVLCQAHGLTPEQVVAIASNIGGKQALETVQALLPVLCQAHGLTPEQVVAIASHDGG
KQALETVQALLPVLCQAHGLTPEQVVAIASNGGGKQALETVQALLPVLCQAHGLTPEQ
VVAIASNNGGKQALETVQRLLPVLCQAHGLTPEQVVAIASHDGGKQALETVQALLPVL
CQAHGLTPEQVVAIASNGGGKQALETVQRLLPVLCQAHGLTPEQVVAIASNIGGKQAL
ETVQALLPVLCQAHGLTPEQVVAIASNGGGKQALETVQALLPVLCQAHGLTPEQVVAI
ASNGGGKQALETVQALLPVLCQAHGLTPEQVVAIASNIGGKQALETVQRLLPVLCQAH
GLTPQQVVAIASNGGGKQALETVQRLLPVLCQAHGLTPQQVVAIASNGGGRPALESIV
AQLSRPDPALAALTNDHLVALACLGGRPALDAVKKGLG

ND2-DdCBE Left mitoTALE repeat (SEQ ID NO: 365)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNGGGKQALETVQRLLPVLCQAHGLTPQQVVAIASNGGGKQALETVQR
LLPVLCQAHGLTPEQVVAIASNIGGKQALETVQALLPVLCQAHGLTPEQVVAIASNNG
GKQALETVQALLPVLCQAHGLTPEQVVAIASHDGGKQALETVQALLPVLCQAHGLTPE
QVVAIASNIGGKQALETVQRLLPVLCQAHGLTPEQVVAIASNGGGKQALETVQALLPV
LCQAHGLTPEQVVAIASNIGGKQALETVQRLLPVLCQAHGLTPEQVVAIASHDGGKQA
LETVQALLPVLCQAHGLTPEQVVAIASNGGGKQALETVQALLPVLCQAHGLTPEQVVA
IASHDGGKQALETVQALLPVLCQAHGLTPEQVVAIASHDGGKQALETVQRLLPVLCQA
HGLTPQQVVAIASNGGGKQALETVQRLLPVLCQAHGLTPEQVVAIASHDGGKQALETV
QALLPVLCQAHGLTPEQVVAIASNIGGKQALETVQALLPVLCQAHGLTPEQVVAIASNI
GGKQALETVQALLPVLCQAHGLTPQQVVAIASNGGGRPALESIVAQLSRPDPALAALT
NDHLVALACLGGRPALDAVKKGLG

ND4-DdCBE Right mitoTALE repeat (SEQ ID NO: 366)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASHDGGKQALETVQRLLPVLCQAHGLTPQQVVAIASNGGGKQALETVQR
LLPVLCQAHGLTPEQVVAIASNNGGKQALETVQALLPVLCQAHGLTPEQVVAIASNGG
GKQALETVQALLPVLCQAHGLTPEQVVAIASNIGGKQALETVQALLPVLCQAHGLTPE
QVVAIASNIGGKQALETVQRLLPVLCQAHGLTPEQVVAIASNNGGKQALETVQALLPV
LCQAHGLTPEQVVAIASNGGGKQALETVQRLLPVLCQAHGLTPEQVVAIASNIGGKQA
LETVQRLLPVLCQAHGLTPEQVVAIASNNGGKQALETVQALLPVLCQAHGLTPEQVVA
IASNNGGKQALETVQALLPVLCQAHGLTPEQVVAIASNIGGKQALETVQALLPVLCQA
HGLTPEQVVAIASNNGGKQALETVQRLLPVLCQAHGLTPQQVVAIASNIGGKQALETV

-continued

QRLLPVLCQAHGLTPQQVVAIASNNGGKQALETVQRLLPVLCQAHGLTPQQVVAIASN

GGGRPALESIVAQLSRPDPALAALTNDHLVALACLGGRPALDAVKKGLG

ND4-DdCBE Left mitoTALE repeat (SEQ ID NO: 367)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASNNGGKQALETVQALLPVLCQAHGL

TPQQVVAIASHDGGKQALETVQRLLPVLCQAHGLTPQQVVAIASNGGGKQALETVQR

LLPVLCQAHGLTPEQVVAIASNIGGKQALETVQALLPVLCQAHGLTPEQVVAIASNNG

GKQALETVQALLPVLCQAHGLTPEQVVAIASNGGGKQALETVQALLPVLCQAHGLTPE

QVVAIASNIGGKQALETVQRLLPVLCQAHGLTPEQVVAIASNIGGKQALETVQALLPVL

CQAHGLTPEQVVAIASHDGGKQALETVQRLLPVLCQAHGLTPEQVVAIASHDGGKQA

LETVQALLPVLCQAHGLTPEQVVAIASNIGGKQALETVQALLPVLCQAHGLTPEQVVAI

ASHDGGKQALETVQALLPVLCQAHGLTPEQVVAIASNNGGKQALETVQRLLPVLCQA

HGLTPQQVVAIASNGGGKQALETVQRLLPVLCQAHGLTPEQVVAIASNGGGKQALETV

QALLPVLCQAHGLTPEQVVAIASHDGGKQALETVQALLPVLCQAHGLTPQQVVAIASN

GGGRPALESIVAQLSRPDPALAALTNDHLVALACLGGRPALDAVKKGLG

ND5.1-DdCBE Right mitoTALE repeat (SEQ ID NO: 368)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPQQVVAIASHDGGKQALETVQRLLPVLCQAHGL

TPEQVVAIASNGGGKQALETVQRLLPVLCQAHGLTPQQVVAIASNGGGKQALETVQRL

LPVLCQAHGLTPEQVVAIASNGGGKQALETVQALLPVLCQAHGLTPQQVVAIASNNGG

KQALETVQRLLPVLCQAHGLTPQQVVAIASNNGGKQALETVQRLLPVLCQAHGLTPEQ

VVAIASNIGGKQALETVQRLLPVLCQAHGLTPQQVVAIASNNGGKQALETVQRLLPVL

CQAHGLTPQQVVAIASNGGGKQALETVQRLLPVLCQAHGLTPEQVVAIASNIGGKQAL

ETVQRLLPVLCQAHGLTPEQVVAIASNNGGKQALETVQRLLPVLCQAHGLTPQQVVAI

ASNIGGKQALETVQRLLPVLCQAHGLTPQQVVAIASNIGGRPALESIVAQLSRPDPALA

ALTNDHLVALACLGGRPALDAVKKGLG

ND5.1-DdCBE Left mitoTALE repeat (SEQ ID NO: 369)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASNIGGKQALETVQALLPVLCQAHGL

TPQQVVAIASNNGGKQALETVQRLLPVLCQAHGLTPQQVVAIASHDGGKQALETVQR

LLPVLCQAHGLTPEQVVAIASNIGGKQALETVQALLPVLCQAHGLTPEQVVAIASNGG

GKQALETVQALLPVLCQAHGLTPEQVVAIASNGGGKQALETVQALLPVLCQAHGLTPE

QVVAIASNIGGKQALETVQRLLPVLCQAHGLTPEQVVAIASNNGGKQALETVQALLPV

LCQAHGLTPEQVVAIASHDGGKQALETVQRLLPVLCQAHGLTPEQVVAIASNIGGKQA

LETVQALLPVLCQAHGLTPEQVVAIASNNGGKQALETVQALLPVLCQAHGLTPEQVVA

IASNNGGKQALETVQALLPVLCQAHGLTPEQVVAIASNIGGKQALETVQRLLPVLCQA

HGLTPQQVVAIASNIGGKQALETVQRLLPVLCQAHGLTPQQVVAIASNGGGRPALESIV

AQLSRPDPALAALTNDHLVALACLGGRPALDAVKKGLG

-continued

ND5.2-DdCBE Right mitoTALE repeat (Note: Terminal NG RVD recognizes a mismatched T instead of a G in the reference genome)

(SEQ ID NO: 370)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASNNGGKQALETVQRLLPVLCQAHGL
TPEQVVAIASHDGGKQALETVQRLLPVLCQAHGLTPQQVVAIASNGGGKQALETVQRL
LPVLCQAHGLTPEQVVAIASNIGGKQALETVQALLPVLCQAHGLTPQQVVAIASNNGG
KQALETVQRLLPVLCQAHGLTPQQVVAIASNNGGKQALETVQRLLPVLCQAHGLTPEQ
VVAIASHDGGKQALETVQRLLPVLCQAHGLTPQQVVAIASNGGGKQALETVQRLLPVL
CQAHGLTPQQVVAIASNNGGKQALETVQRLLPVLCQAHGLTPEQVVAIASHDGGKQA
LETVQRLLPVLCQAHGLTPEQVVAIASHDGGKQALETVQRLLPVLCQAHGLTPEQVVA
IASNIGGKQALETVQALLPVLCQAHGLTPEQVVAIASNIGGKQALETVQALLPVLCQAH
GLTPQQVVAIASNGGGKQALETVQRLLPVLCQAHGLTPQQVVAIASNNGGKQALETV
QRLLPVLCQAHGLTPQQVVAIASNGGGRPALESIVAQLSRPDPALAALTNDHLVALAC
LGGRPALDAVKKGLG

ND5.2-DdCBE Left mitoTALE repeat (SEQ ID NO: 371)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPEQVVAIASHDGGKQALETVQALLPVLCQAHGL
TPQQVVAIASNIGGKQALETVQRLLPVLCQAHGLTPQQVVAIASNIGGKQALETVQRLL
PVLCQAHGLTPEQVVAIASNIGGKQALETVQALLPVLCQAHGLTPEQVVAIASNIGGKQ
ALETVQALLPVLCQAHGLTPEQVVAIASHDGGKQALETVQALLPVLCQAHGLTPEQVV
AIASHDGGKQALETVQRLLPVLCQAHGLTPEQVVAIASNIGGKQALETVQALLPVLCQ
AHGLTPEQVVAIASNGGGKQALETVQRLLPVLCQAHGLTPEQVVAIASNIGGKQALET
VQALLPVLCQAHGLTPEQVVAIASHDGGKQALETVQALLPVLCQAHGLTPEQVVAIAS
HDGGKQALETVQALLPVLCQAHGLTPEQVVAIASNGGGKQALETVQRLLPVLCQAHG
LTPQQVVAIASHDGGKQALETVQRLLPVLCQAHGLTPQQVVAIASNGGGRPALESIVA
QLSRPDPALAALTNDHLVALACLGGRPALDAVKKGLG

ND5.3-DdCBE Right mitoTALE repeat (SEQ ID NO: 372)

DIADLRTLGYSQQQQEKIKPKVRSTVAQHHEALVGHGFTHAHIVALSQHPAALGTVAV
KYQDMIAALPEATHEAIVGVGKQWSGARALEALLTVAGELRGPPLQLDTGQLLKIAKR
GGVTAVEAVHAWRNALTGAPLNLTPQQVVAIASNIGGKQALETVQRLLPVLCQAHGL
TPEQVVAIASNIGGKQALETVQRLLPVLCQAHGLTPQQVVAIASNNGGKQALETVQRL
LPVLCQAHGLTPEQVVAIASNIGGKQALETVQALLPVLCQAHGLTPQQVVAIASNGGG
KQALETVQRLLPVLCQAHGLTPQQVVAIASNGGGKQALETVQRLLPVLCQAHGLTPEQ
VVAIASNIGGKQALETVQRLLPVLCQAHGLTPQQVVAIASNNGGKQALETVQRLLPVL
CQAHGLTPQQVVAIASNGGGKQALETVQRLLPVLCQAHGLTPEQVVAIASNIGGKQAL
ETVQRLLPVLCQAHGLTPEQVVAIASNGGGKQALETVQRLLPVLCQAHGLTPQQVVAI
ASNNGGKQALETVQRLLPVLCQAHGLTPQQVVAIASNNGGKQALETVQRLLPVLCQA
HGLTPQQVVAIASNGGGRPALESIVAQLSRPDPALAALTNDHLVALACLGGRPALDAV
KKGLG

-continued

ND5.3-DdCBE Left mitoTALE repeat (SEQ ID NO: 373)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASHDGGKQALETVQALLPVLCQAHGL

TPQQVVAIASNIGGKQALETVQRLLPVLCQAHGLTPQQVVAIASNNGGKQALETVQRL

LPVLCQAHGLTPEQVVAIASNGGGKQALETVQALLPVLCQAHGLTPEQVVAIASNGGG

KQALETVQALLPVLCQAHGLTPEQVVAIASHDGGKQALETVQALLPVLCQAHGLTPEQ

VVAIASNGGGKQALETVQRLLPVLCQAHGLTPEQVVAIASNGGGKQALETVQALLPVL

CQAHGLTPEQVVAIASHDGGKQALETVQRLLPVLCQAHGLTPEQVVAIASNIGGKQAL

ETVQALLPVLCQAHGLTPEQVVAIASNIGGKQALETVQALLPVLCQAHGLTPEQVVAIA

SNIGGKQALETVQALLPVLCQAHGLTPEQVVAIASNGGGKQALETVQRLLPVLCQAHG

LTPQQVVAIASNIGGKQALETVQRLLPVLCQAHGLTPQQVVAIASNGGGRPALESIVAQ

LSRPDPALAALTNDHLVALACLGGRPALDAVKKGLG

ATP8-DdCBE Right mitoTALE repeat (Note: Terminal NG RVD recognizes a mismatched T instead of a C in the reference genome)

(SEQ ID NO: 374)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPQQVVAIASNIGGKQALETVQRLLPVLCQAHGL

TPEQVVAIASNGGGKQALETVQRLLPVLCQAHGLTPQQVVAIASNNGGKQALETVQRL

LPVLCQAHGLTPEQVVAIASNNGGKQALETVQALLPVLCQAHGLTPQQVVAIASNNGG

KQALETVQRLLPVLCQAHGLTPQQVVAIASHDGGKQALETVQRLLPVLCQAHGLTPEQ

VVAIASNGGGKQALETVQRLLPVLCQAHGLTPQQVVAIASNGGGKQALETVQRLLPVL

CQAHGLTPQQVVAIASNGGGKQALETVQRLLPVLCQAHGLTPEQVVAIASNNGGKQA

LETVQRLLPVLCQAHGLTPEQVVAIASNNGGKQALETVQRLLPVLCQAHGLTPQQVVA

IASNGGGRPALESIVAQLSRPDPALAALTNDHLVALACLGGRPALDAVKKGLG

ATP8-DdCBE Left mitoTALE repeat (SEQ ID NO: 375)

DIADLRTLGYSQQQQEKIKPKVRSTVAQHHEALVGHGFTHAHIVALSQHPAALGTVAV

KYQDMIAALPEATHEAIVGVGKQWSGARALEALLTVAGELRGPPLQLDTGQLLKIAKR

GGVTAVEAVHAWRNALTGAPLNLTPEQVVAIASNIGGKQALETVQALLPVLCQAHGL

TPQQVVAIASNGGGKQALETVQRLLPVLCQAHGLTPQQVVAIASNGGGKQALETVQR

LLPVLCQAHGLTPEQVVAIASNIGGKQALETVQALLPVLCQAHGLTPEQVVAIASNIGG

KQALETVQALLPVLCQAHGLTPEQVVAIASNIGGKQALETVQALLPVLCQAHGLTPEQ

VVAIASHDGGKQALETVQRLLPVLCQAHGLTPEQVVAIASNIGGKQALETVQALLPVL

CQAHGLTPEQVVAIASHDGGKQALETVQRLLPVLCQAHGLTPEQVVAIASNIGGKQAL

ETVQALLPVLCQAHGLTPEQVVAIASNIGGKQALETVQALLPVLCQAHGLTPEQVVAIA

SNIGGKQALETVQALLPVLCQAHGLTPEQVVAIASHDGGKQALETVQRLLPVLCQAHG

LTPQQVVAIASNGGGKQALETVQRLLPVLCQAHGLTPEQVVAIASNIGGKQALETVQA

LLPVLCQAHGLTPQQVVAIASNGGGRPALESIVAQLSRPDPALAALTNDHLVALACLG

GRPALDAVKKGLG

Example 2: New DddA Mutants with Improved Editing Activity at TC Context

As noted in Example 1, DdCBE editing activity at selected sites, including MT-ATP8 and MT-ND5.2, remained low (<10%) across all possible G1333 and G1397 split orientations. Phage-assisted non-continuous and continuous evolution (PANCE and PACE) was applied to evolve split-DddA (Thuronyi. B. W, et al. Nat Biotechnol 37. 1070-1079(2019)). (FIG. 59), resulting in variants that contained mutations in the N-terminal and C-terminal halves of split DddA (FIGS. 60A-60D). Exemplary variant sequences are shown:

| Mutation(s) | Sequence | SEQ ID NO: |
|---|---|---|
| DddA (residues 1290-1427) | GSYALGPYQISAPQLPAYNGQTVGTFYYVNDAGGLESKVFSSGGPTP YPNYANAGHVEGQSALFMRDNGISEGLVFHNNPEGTCGFCVNMTET LLPENAKMTVVPPEGAIPVKRGATGETKVFTGNSNSPKSPTKGGC | 338 |
| T1380I | GSYALGPYQISAPQLPAYNGQTVGTFYYVNDAGGLESKVFSSGGPTP YPNYANAGHVEGQSALFMRDNGISEGLVFHNNPEGTCGFCVNMIETL LPENAKMTVVPPEGAIPVKRGATGETKVFTGNSNSPKSPTKGGC | 377 |
| T1314A/T1380I | GSYALGPYQISAPQLPAYNGQTVGAFYYVNDAGGLESKVFSSGGPTP YPNYANAGHVEGQSALFMRDNGISEGLVFHNNPEGTCGFCVNMIETL LPENAKMTVVPPEGAIPVKRGATGETKVFTGNSNSPKSPTKGGC | 378 |
| Q1310R/S1330I/ T1380I | GSYALGPYQISAPQLPAYNGRTVGTFYYVNDAGGLESKVFISGGPTP YPNYANAGHVEGQSALFMRDNGISEGLVFHNNPEGTCGFCVNMIETL LPENAKMTVVPPEGAIPVKRGATGETKVFTGNSNSPKSPTKGGC | 379 |
| T1380I/T1413I | GSYALGPYQISAPQLPAYNGQTVGTFYYVNDAGGLESKVFSSGGPTP YPNYANAGHVEGQSALFMRDNGISEGLVFHNNPEGTCGFCVNMIETL LPENAKMTVVPPEGAIPVKRGATGETKVFIGNSNSPKSPTKGGC | 380 |
| T1314A/T1380I/ E1396K | GSYALGPYQISAPQLPAYNGQTVGAFYYVNDAGGLESKVFSSGGPTP YPNYANAGHVEGQSALFMRDNGISEGLVFHNNPEGTCGFCVNMIETL LPENAKMTVVPPKGAIPVKRGATGETKVFTGNSNSPKSPTKGGC | 381 |

These DddA mutations were cloned into the DdCBE architecture (MTS-right TALE-G1397 split DddA-(N/C)-UGI) and plasmid transfected into human HEK293T cells (FIG. 60A). At sites that were weakly editing by the wild-type DdCBE, editor variant T1380I improved editing efficiencies 1.2-2.3 fold (FIG. 60B), and variants Q1310R/S1330I/T1380I and T1380I/T1413I improved editing efficiencies by 4.8-4.9-fold up to 40%. (FIG. 60C). The indels associated with the highly active variants remained below the 0.1% detection limit (FIG. 60D). Using directed protein evolution, split G1397-DddA variants that show greatly improved editing efficiencies over the wildtype DddA were successfully evolved.

Example 3. Lentiviral Delivery of DdCBEs into Mouse Cells

The ability of DdCBEs to install disease-causing mutations in animal models will accelerate the study of disease etiology and facilitate preclinical testing of drug candidates. In particular, mutations in mitochondrial genes encoding for Complex I subunits are increasingly studied for their role in cancer (Gopal, R. K, et al. Cancer Cell 34, 242-255.e245 (2018)). DdCBEs were designed that target various Complex I genes in the mouse mtDNA to install a pathogenic missense mutation. The right and left halves of each DdCBE were cloned separately into a lentiviral vector and co-transfected into mouse embryonic fibroblasts (FIG. 61). Sanger sequencing of cells that express both DdCBEs halves showed efficient DdCBE editing at the target mtDNA site (FIG. 62). Compared to untreated cells, cells containing these pathogenic mutations had lower oxygen consumption rates and higher extracellular acidification rates, indicating a preference for glycolysis over oxidative phosphorylation (FIG. 63). These results collectively indicate that DdCBEs is compatible with existing viral delivery platforms and can be applied to generate relevant disease cell lines, and potentially animal models.

Example 4. Alternative DdCBE Architectures

The original DdCBE design, described in Example 1, contains a Left-TALE that targets the top coding DNA strand and a Right-TALE that targets the bottom coding DNA strand (FIG. 64A). TALEs that bind in this orientation brings the two inactive DddA halves in close proximity for reassembly. It was observed that mtDNA editing efficiencies and editing window are partly dependent on the length of the spacing region and the position of the target C within the spacing region. These parameters can be optimized through testing of different TALE sequences. This effort, however, has been hampered by strict guidelines governing the design of high affinity-binding TALEs (Rogers, J. M, et al. Nat Commun 6, 7440 (2015))., To expand the options for TALE design three other alternative DdCBE architectures were generated. In the "Opposite" design, the Left-TALE binds to the bottom DNA strand and the Right-TALE binds to the top DNA strand (FIG. 64B). For DdCBEs containing monomers that bind to the same DNA strand, the TALEs can target either the top strand or bottom strand (FIG. 64B). To maintain editing activity in these alternative architectures, the MTS is fused to the N-terminus and the UGI must be distal to the MTS for localization of the editor into the mitochondria.

In general, the editing efficiencies observed for the alternative DdCBE architectures were generally lower than the original DdCBE design (FIG. 65). In particular, the Opposite architecture abrogated editing at target cytosines that had been most efficiently edited by the Original design (up to 35%). These results indicate that while these alternative DdCBE architectures remain active, they should only be used when there are no available TALE binding sites that correspond to the Original architecture. An exemplary protein sequence is shown below:

```
MTS-split DddA half G1397-N-ND1 Right TALE
repeat-UGI
                                   (SEQ ID NO: 420)
SVLTPLLLRGLTGSARRLPVPRAKIHSLMGSYALGPYQISAPQLPAYNG

QTVGTFYYVNDAGGLESKVFSSGGPTPYPNYANAGHVEGQSALFMRDNG

ISEGLVFHNNPEGTCGFCVNMTETLLPENAKMTVVPPEGGSDIADLRTL

GYSQQQQEKIKPKVRSTVAQHHEALVGHGFTHAHIVALSQHPAALGTVA

VKYQDMIAALPEATHEAIVGVGKQWSGARALEALLTVAGELRGPPLQLD

TGQLLKIAKRGGVTAVEAVHAWRNALTGAPLNLTPEQVVAIASHDGGKQ

ALETVQALLPVLCQAHGLTPQQVVAIASNIGGKQALETVQRLLPVLCQA

HGLTPQQVVAIASNNGGKQALETVQRLLPVLCQAHGLTPEQVVAIASNN

GGKQALETVQALLPVLCQAHGLTPEQVVAIASNNGGKQALETVQALLPV

LCQAHGLTPEQVVAIASNGGGKQALETVQALLPVLCQAHGLTPEQVVAI

ASNNGGKQALETVQRLLPVLCQAHGLTPEQVVAIASNIGGKQALETVQA

LLPVLCQAHGLTPEQVVAIASNNGGKQALETVQRLLPVLCQAHGLTPEQ

VVAIASHDGGKQALETVQALLPVLCQAHGLTPEQVVAIASNIGGKQALE

TVQALLPVLCQAHGLTPQQVVAIASNGGGRPALESIVAQLSRPDPALAA

LTNDHLVALACLGGRPALDAVKKGLGSGGSTNLSDIIEKETGKQLVIQE

SILMLPEEVEEVIGNKPESDILVHTAYDESTDENVMLLTSDAPEYKPWA

LVIQDSNGENKIKML
```

Example 5. Mitochondrial Base Editing with ZF-BE

A process for ZF-BE base editing was designed as an alternative to TALE-DdCBE described in the Examples above. As ZFs (0.5kb) are smaller than TALE (2kb), it was believed that ZF-BEs would allow for better expression and lower immunogenicity, as well as single AAV base editing (2x 1.2 kb). However, to date, no published pairs of mitoZFs exist which target the wild-type genome sequence. As a result, ZFs were designed to be used in combination previously reported mitoZFs R13-1 and R8 (Gammage et al. EMBO Mol Med. 2014 April; 6(4):458-66.)

ZF-B's Design

ZF-BEs were designed to comprise the following components:

- Mitochondrial Targeting Sequence (MTS) for import of a cytosolic-located protein into the mitochondria. Localisation of the ZF-BE in the mitochondria is critical for its ability to edit mitochondrial DNA.
- FLAG tag which serves two roles—firstly as an affinity tag allowing both expression levels of the ZF-BE to be determined by Western Blot using an anti-FLAG antibody, and intracellular localization to be imaged by antibody staining of transfected cells by microscopy. Secondly, as a disordered sequence following the MTS which improves mitochondrial import via the MTS, facilitating better loading and protein unfolding through mitochondrial import channel.
- Nuclear Export Sequence (NES) for export of a nuclear-located protein into the cytosol, where it can then be transported into the mitochondria via its MTS. Since ZFs inherently encode a Nuclear Localisation Sequence (NLS), this is important to counteract their natural tendency to localize in the nucleus which is problematic for editing mitochondrial DNA. Utilising two separate NES boosts the cytoplasmic localization of ZF-BEs by further reducing their nuclear localization, enabling stronger uptake of ZF-BEs into the mitochondria for BE to occur.
- Zinc Finger (ZF) as a DNA-binding domain able to specify the target sequence for the ZF-BE to bind to within mitochondrial DNA and target the split DddA deaminase towards site-specific base editing.
- Split DddA deaminase, capable of performing deamination on dsDNA when reconstituted into a full-length DddA at the target site within mitochondrial DNA when both halves of the DddA deaminase are colocalized.
- Uracil glycosylase inhibitor (UGI) for binding to mitochondrial uracil DNA glycosylase (UDG) and inhibiting the activity of UDG to excise modified uracil bases from edited DNA.
- P2A peptide enabling coexpression of two independent polypeptides from a single gene-encoding sequence due to the inability of the mammalian ribosome to form complete polypeptide bond formation during translation. This is used to enable coexpression of an additional copy of UGI from the same gene-encoding sequence which can independently localize into mitochondria via its own MTS, increasing the level of mitochondrial UDG inhibition.

Optimisation of ZF-BE Architecture

ZFs were designed to target two sites in the mitochondrial genome: ATP8 (referred to as R8) and ND5.1 (referred to as R 13). ZFs were designed using a modular assembly approach, using a modified Zif268 scaffold. At each site ZFs were designed to form one half of a pair alongside R8 or R13-1. The resulting set of ZFs bound to sequences and created an editing window between the ZF pair, ranging from 4-18 bp. Binding motifs are shown in FIG. 66. Results from initial experiments (vI) are shown in FIGS. 67-70D. Based on this data, designed ZFs 5xZnF-4-R8 and 5xZnF-10-R8 (site R8), and5xZnF-9-R13 and 5xZnF-12-R13 (site R13) were deemed to be the best performing.

The architecture of the lead vi ZF-BE candidates were varied with regards to MTS, NES and linker length (v2) (FIGS. 71A-71B). Results showed that vi MTS and NES outperformed v2 MTSi/2 and NESi/2 (FIGS. 72-75B). The optimal linker length varied between different sites, suggesting that varying linker length may be a route to restricting the editng window. Link13 was chosen for further experimentation as it returned the best results across both sites. Results also showed that varying the ZF binding site, and in turn the editing window size, appeared to be an effective route for changing targeted nucleotide edits.

The ZF-BE architecture was further optimized by retaining the Linki3 flexible linker and the N-terminal MTS and NES from v2 experiments. V3 systematically varied the MTS in the presence or absence of an affinity tag sequence (FLAG or HA) immediately following the MTS (FIG. 76). Results showed that the Minczuk (Mzk) MTS in the presence of a FLAG tag was the best performing architecture (FIGS. 77A-77D) and these improvements were used in further experimentation.

The next round of optimization tested additional NES sequences (×3), different UGI homologs (×2) and ZF scaffold mutations (FIG. 78, v4). Results showed that adding an extra NES to the c-terminus ("NESX") did not improve editing efficiencies. However, adding an extra internal NES ("IntNES2") downstream of the existing NES improved editing efficiencies (FIGS. 79A-79D) and was carried forward in further experimentation. Results of editing with alternative UGI homologs did not show any improvement to ZF base editing (FIGS. 80A-80D). ZFs naturally localize in the nucleus and the ZF sequence is necessary and sufficient for nuclear localization. However, nuclear localization is not dependent or tertiary structure and mutation of conserved His/Cys residues which coordinate $Zn^{2+}$ does not perturb nuclear localization. As a result, mutation of positively charged residues can reduce nuclear localization. FIGS. 81A-81C show ZF scaffolding with non-conserved positively charged residues in bold. These residues were targeted for mutations (FIG. 81C) to ablate the positive charge and reduce the overall NLS quality of the ZF. Results of ZF scaffold mutations showed that the N and combined DN set of mutations did not improve editing efficiency. However, the D mutation set improved editing efficiency and these mutations were carried forward for further experimentation (FIGS. 82A-82D).

The D mutations were combined with previous architecture improvements (FIG. 83, v5). Results confirmed that D mutations are beneficial and that combining these with the additional internal NES could improve editing efficiency further (D2=D+IntNES2; D3=D+IntNES3) (FIGS. 84A-84D). V5 experiments showed that moving the UGI to the N-terminus did not improve results. However, increasing the amount of UGI delivered to the mitochdria, either by appending 2X UGI or by following the editor with an extra copy of UGI expressed in trans and targeted to mitochondria via its own MTS, led to an improvement in editing efficiency (FIGS. 85A-85D).

The final round of optimization included an additional NES, improvement of the ZF scaffold sequence, and coexpression of a separate mitochondrially-targeted UGI (FIG. 86, v6). Inclusion of mutations T1380I, E1396K and T14131 into the split DddA deaminase halves were also tested (FIG. 86, v6M). Sequences for architectures shown FIG. 86 are described below. Results of editing efficiency are shown in FIG. 87B.

| | | |
|---|---|---|
| R8 v6 | MLGFVGRVAAAPASGALRRLTPSASLPP<br>AQLLLRAAPTAVHPVRDYAAQDYKDD<br>DDKVDEMTKKFGTLTIHDTEKGSLQKK<br>LEELELDAAMAERPFQCDICMRNFSTSG<br>SLSRHIRTHTGEKPFQCDICMRNFSQSGS<br>LTRHIRTHTGSEKPFQCDICMRNFSRSDA<br>LSQHIRTHTGEKPFQCDICMRNFSRNDN<br>RITHIRTHTGEKPFQCDICMRNFSRSDHL<br>TQHTKIHLRGSGGGGSGGSGGSGSYAL<br>GPYQISAPQLPAYNGQTVGTFYYVNDA<br>GGLESKVFSSGGPTPYPNYANAGHVEG<br>QSALFMRDNGISEGLVFHNNPEGTCGFC<br>VNMTETLLPENAKMTVVPPEGSGGSTN<br>LSDIIEKETGKQLVIQESILMLPEEVEEVI<br>GNKPESDILVHTAYDESTDENVMLLTSD<br>APEYKPWALVIQDSNGENKIKMLGSGA<br>TNFSLLKQAGDVEENPGPMASVLTPLLL<br>RGLTGSARRLPVPRAKIHSLGSTNLSDII<br>EKETGKQLVIQESILMLPEEVEEVIGNKP<br>ESDILVHTAYDESTDENVMLLTSDAPEY<br>KPWALVIQDSNGENKIKML (SEQ ID NO:<br>382) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LQKKLEELELD (SEQ ID NO: 397)<br>Linker<br>AA<br>ZF (R8)<br>MAERPFQCDICMRNFSTSGSLSRHIRTHTGEKPF<br>QCDICMRNFSQSGSLTRHIRTHTGSEKPFQCDIC<br>MRNFSRSDALSQHIRTHTGEKPFQCDICMRNFS<br>RNDNRITHIRTHTGEKPFQCDICMRNFSRSDHL<br>TQHTKIHLR (SEQ ID NO: 398)<br>Linker<br>GSGGGGSGGSGGS (SEQ ID NO: 399)<br>Split DddA (DddA-G1397N)<br>GSYALGPYQISAPQLPAYNGQTVGTFYYVNDA<br>GGLESKVFSSGGPTPYPNYANAGHVEGQSALF<br>MRDNGISEGLVFHNNPEGTCGFCVNMTETLLP<br>ENAKMTVVPPEG (SEQ ID NO: 284)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL<br>(SEQ ID NO: 401)<br>Linker<br>GS<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-4-<br>R8 v6 | MLGFVGRVAAAPASGALRRLTPSASLPP<br>AQLLLRAAPTAVHPVRDYAAQDYKDD<br>DDKVDEMTKKFGTLTIHDTEKGSLQKK<br>LEELELDAAMAERPFQCDICMRNFSQAS<br>NLISHIRTHTGEKPFQCDICMRNFSTSHS<br>LTEHIRTHTGSEKPFQCDICMRNFSERSH<br>LREHIRTHTGEKPFQCDICMRNFSQSGN | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396) |

| | | |
|---|---|---|
| | LTEHIRTHTGEKPFQCDICMRNFSSKKA LTEHTKIHLRGSGGGGSGGSGGSAIPVK RGATGETKVFTGNSNSPKSPTKGGCSGG STNLSDIIEKETGKQLVIQESILMLPEEVE EVIGNKPESDILVHTAYDESTDENVMLL TSDAPEYKPWALVIQDSNGENKIKMLGS GATNFSLLKQAGDVEENPGPMASVLTP LLLRGLTGSARRLPVPRAKIHSLGSTNLS DIIEKETGKQLVIQESILMLPEEVEEVIGN KPESDILVHTAYDESTDENVMLLTSDAP EYKPWALVIQDSNGENKIKML (SEQ ID NO: 383) | Linker<br>GS<br>NES2<br>LQKKLEELELD (SEQ ID NO: 397)<br>Linker<br>AA<br>ZF (5xZnF-4-R8)<br>MAERPFQCDICMRNFSQASNLISHIRTHTGEKPF QCDICMRNFSTSHSLTEHIRTHTGSEKPFQCDIC MRNFSERSHLREHIRTHTGEKPFQCDICMRNFS QSGNLTEHIRTHTGEKPFQCDICMRNESSKKAL TEHTKIHLR (SEQ ID NO: 402)<br>Linker<br>GSGGGGSGGSGGS (SEQ ID NO: 399)<br>Split DddA (DddA-G1397C)<br>AIPVKRGATGETKVFTGNSNSPKSPTKGGC (SEQ ID NO: 286)<br>Linker<br>SGGS (SEQ ID NO: 348)<br>UGI<br>TNLSDIIEKETGKQLVIQESILMLPEEVEEVIGNK PESDILVHTAYDESTDENVMLLTSDAPEYKPW ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL (SEQ ID NO: 401)<br>Linker<br>GS<br>UGI<br>TNLSDIIEKETGKQLVIQESILMLPEEVEEVIGNK PESDILVHTAYDESTDENVMLLTSDAPEYKPW ALVIQDSNGENKIKML (SEQ ID NO: 341) |
| 5xZnF-10-R8 v6 | MLGFVGRVAAAPASGALRRLTPSASLPP AQLLLRAAPTAVHPVRDYAAQDYKDD DDKVDEMTKKFGTLTIHDTEKGSLQKK LEELELDAAMAERPFQCDICMRNFSQAS NLISHIRTHTGEKPFQCDICMRNFSQRAN LRAHIRTHTGSEKPFQCDICMRNFSQAS NLISHIRTHTGEKPFQCDICMRNFSTSHS LTEHIRTHTGEKPFQCDICMRNFSERSHL REHTKIHLRGSGGGGSGGSGGSAIPVKR GATGETKVFTGNSNSPKSPTKGGCSGGS TNLSDIIEKETGKQLVIQESILMLPEEVEE VIGNKPESDILVHTAYDESTDENVMLLT SDAPEYKPWALVIQDSNGENKIKMLGS GATNFSLLKQAGDVEENPGPMASVLTP LLLRGLTGSARRLPVPRAKIHSLGSTNLS DIIEKETGKQLVIQESILMLPEEVEEVIGN KPESDILVHTAYDESTDENVMLLTSDAP EYKPWALVIQDSNGENKIKML (SEQ ID NO: 384) | MTS<br>MLGFVGRVAAAPASGALRRLTPSASLPPAQLLL RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LQKKLEELELD (SEQ ID NO: 397)<br>Linker<br>AA<br>ZF (5xZnF-10-R8)<br>MAERPFQCDICMRNFSQASNLISHIRTHTGEKPF QCDICMRNFSQRANLRAHIRTHTGSEKPFQCDI CMRNFSQASNLISHIRTHTGEKPFQCDICMRNFS TSHSLTEHIRTHTGEKPFQCDICMRNFSERSHLR EHTKIHLR (SEQ ID NO: 403)<br>Linker<br>GSGGGGSGGSGGS (SEQ ID NO: 399)<br>Split DddA (DddA-G1397C)<br>AIPVKRGATGETKVFTGNSNSPKSPTKGGC (SEQ ID NO: 286)<br>Linker<br>SGGS (SEQ ID NO: 348)<br>UGI<br>TNLSDIIEKETGKQLVIQESILMLPEEVEEVIGNK PESDILVHTAYDESTDENVMLLTSDAPEYKPW ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL (SEQ ID NO: 401) |

-continued

| | | |
|---|---|---|
| | | Linker<br>GS<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| R13-1 v6 | MLGFVGRVAAAPASGALRRLTPSASLPP<br>AQLLLRAAPTAVHPVRDYAAQDYKDD<br>DDKVDEMTKKFGTLTIHDTEKGSLQKK<br>LEELELDAAMAERPFQCDICMRNFSRSD<br>NLSTHIRTHTGEKPFQCDICMRNFSDRS<br>DLSRHIRTHTGEKPFQCDICMRNFSQSG<br>DLTRHIRTHTGSEKPFQCDICMRNFSRSD<br>SLSAHIRTHTGEKPFQCDICMRNFSQKA<br>TRITHTKIHLRGSGGGGSGGSGGSGSYA<br>LGPYQISAPQLPAYNGQTVGTFYYVND<br>AGGLESKVFSSGGPTPYPNYANAGHVE<br>GQSALFMRDNGISEGLVFHNNPEGTCGF<br>CVNMTETLLPENAKMTVVPPEGSGGST<br>NLSDIIEKETGKQLVIQESILMLPEEVEEV<br>IGNKPESDILVHTAYDESTDENVMLLTS<br>DAPEYKPWALVIQDSNGENKIKMLGSG<br>ATNFSLLKQAGDVEENPGPMASVLTPLL<br>LRGLTGSARRLPVPRAKIHSLGSTNLSDI<br>IEKETGKQLVIQESILMLPEEVEEVIGNK<br>PESDILVHTAYDESTDENVMLLTSDAPE<br>YKPWALVIQDSNGENKIKML (SEQ ID<br>NO: 385) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LqKKLEELELD (SEQ ID NO: 397)<br>Linker<br>AA<br>ZF (R13-1)<br>MAERPFQCDICMRNFSRSDNLSTHIRTHTGEKP<br>FQCDICMRNFSDRSDLSRHIRTHTGEKPFQCDIC<br>MRNFSQSGDLTRHIRTHTGSEKPFQCDICMRNF<br>SRSDSLSAHIRTHTGEKPFQCDICMRNFSQKAT<br>RITHTKIHLR (SEQ ID NO: 404)<br>Linker<br>GSGGGGSGGSGGS (SEQ ID NO: 399)<br>Split DddA (DddA-G1397N)<br>GSYALGPYQISAPQLPAYNGQTVGTFYYVNDA<br>GGLESKVFSSGGPTPYPNYANAGHVEGQSALF<br>MRDNGISEGLVFHNNPEGTCGFCVNMTETLLP<br>ENAKMTVVPPEG (SEQ ID NO: 284)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL<br>(SEQ ID NO: 401)<br>Linker<br>GS<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-9-<br>R13 v6 | MLGFVGRVAAAPASGALRRLTPSASLPP<br>AQLLLRAAPTAVHPVRDYAAQDYKDD<br>DDKVDEMTKKFGTLTIHDTEKGSLQKK<br>LEELELDAAMAERPFQCDICMRNFSQSS<br>SLVRHIRTHTGEKPFQCDICMRNFSRSD<br>NLVRHIRTHTGSEKPFQCDICMRNFSQA<br>GHLASHIRTHTGEKPFQCDICMRNFSRK<br>DNLKNHIRTHTGEKPFQCDICMRNFSRK<br>DALRGHTKIHLRGSGGGGSGGSGGSAIP<br>VKRGATGETKVFTGNSNSPKSPTKGGCS<br>GGSTNLSDIIEKETGKQLVIQESILMLPEE<br>VEEVIGNKPESDILVHTAYDESTDENVM<br>LLTSDAPEYKPWALVIQDSNGENKIKML<br>GSGATNFSLLKQAGDVEENPGPMASVL<br>TPLLLRGLTGSARRLPVPRAKIHSLGSTN<br>LSDIIEKETGKQLVIQESILMLPEEVEEVI<br>GNKPESDILVHTAYDESTDENVMLLTSD<br>APEYKPWALVIQDSNGENKIKML (SEQ<br>ID NO: 386) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LQKKLEELELD (SEQ ID NO: 397)<br>Linker<br>AA<br>ZF (5xZnF-9-R13)<br>MAERPFQCDICMRNFSQSSSLVRHIRTHTGEKP<br>FQCDICMRNFSRSDNLVRHIRTHTGSEKPFQCDI<br>CMRNFSQAGHLASHIRTHTGEKPFQCDICMRNF<br>SRKDNLKNHIRTHTGEKPFQCDICMRNFSRKDA<br>LRGHTKIHLR (SEQ ID NO: 405)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348) |

-continued

| | | |
|---|---|---|
| | | UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL<br>(SEQ ID NO: 401)<br>Linker<br>GS<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-12-R13 v6 | MLGFVGRVAAAPASGALRRLTPSASLPP<br>AQLLLRAAPTAVHPVRDYAAQDYKDD<br>DDKVDEMTKKFGTLTIHDTEKGSLQKK<br>LEELELDAAMAERPFQCDICMRNFSRSD<br>HLTTHIRTHTGEKPFQCDICMRNFSQSSS<br>LVRHIRTHTGSEKPFQCDICMRNFSRSD<br>NLVRHIRTHTGEKPFQCDICMRNFSQAG<br>HLASHIRTHTGEKPFQCDICMRNFSRKD<br>NLKNHTKIHLRGSGGGGSGGSGGSAIPV<br>KRGATGETKVFTGNSNSPKSPTKGGCSG<br>GSTNLSDIIEKETGKQLVIQESILMLPEEV<br>EEVIGNKPESDILVHTAYDESTDENVML<br>LTSDAPEYKPWALVIQDSNGENKIKML<br>GSGATNFSLLKQAGDVEENPGPMASVL<br>TPLLLRGLTGSARRLPVPRAKIHSLGSTN<br>LSDIIEKETGKQLVIQESILMLPEEVEEVI<br>GNKPESDILVHTAYDESTDENVMLLTSD<br>APEYKPWALVIQDSNGENKIKML (SEQ<br>ID NO: 387) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>GS<br>NES2<br>LqKKLEELELD (SEQ ID NO: 397)<br>Linker<br>AA<br>ZF (5xZnF-12-R13)<br>MAERPFQCDICMRNFSRSDHLTTHIRTHTGEKP<br>FQCDICMRNFSQSSSLVRHIRTHTGSEKPFQCDI<br>CMRNFSRSDNLVRHIRTHTGEKPFQCDICMRNF<br>SQAGHLASHIRTHTGEKPFQCDICMRNFSRKDN<br>LKNHTKIHLR (SEQ ID NO: 406)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341)<br>Linker<br>GSG<br>P2A Peptide<br>ATNFSLLKQAGDVEENPGP (SEQ ID NO: 400)<br>MTS<br>MASVLTPLLLRGLTGSARRLPVPRAKIHSL<br>(SEQ ID NO: 401)<br>Linker<br>GS<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| R8 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSTSGSLSRHIRTHTGEKP<br>FACDICGRKFAQSGSLTRHTKIHTGGQR<br>PFQCRICMRNFSRSDALSQHIRTHTGEKP<br>FACDICGRKFARNDNRITHTKIHTGEKPF<br>QCRICMRKFARSDHLTQHTKIHLRGSGG<br>GGSGGSGGSGSYALGPYQISAPQLPAYN<br>GQTVGTFYYVNDAGGLESKVFSSGGPT<br>PYPNYANAGHVEGQSALFMRDNGISEG<br>LVFHNNPEGTCGFCVNMTETLLPENAK<br>MTVVPPEGSGGSTNLSDIIEKETGKQLVI<br>QESILMLPEEVEEVIGNKPESDILVHTAY<br>DESTDENVMLLTSDAPEYKPWALVIQD<br>SNGENKIKML (SEQ ID NO: 388) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (R8)<br>MAERPFQCRICMRNFSTSGSLSRHIRTHTGEKPF<br>ACDICGRKFAQSGSLTRHTKIHTGGQRPFQCRI<br>CMRNFSRSDALSQHIRTHTGEKPFACDICGRKF<br>ARNDNRITHTKIHTGEKPFQCRICMRKFARSDH<br>LTQHTKIHLR (SEQ ID NO: 407)<br>Linker<br>GSGGGGSGGSGGS (SEQ ID NO: 399) |

-continued

| | | |
|---|---|---|
| | | Split DddA (DddA-G1397N)<br>GSYALGPYQISAPQLPAYNGQTVGTFYYVNDA<br>GGLESKVFSSGGPTPYPNYANAGHVEGQSALF<br>MRDNGISEGLVFHNNPEGTCGFCVNMTETLLP<br>ENAKMTVVPPEG (SEQ ID NO: 284)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-4-R8 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSQASNLISHIRTHTGEKP<br>FACDICGRKFATSHSLTEHTKIHTGSQKP<br>FQCRICMRNFSERSHLREHIRTHTGEKPF<br>ACDICGRKFAQSGNLTEHTKIHTGEKPF<br>QCRICMRKFASKKALTEHTKIHLRGSGG<br>GGSGGSGGSAIPVKRGATGETKVFTGNS<br>NSPKSPTKGGCSGGSTNLSDIIEKETGKQ<br>LVIQESILMLPEEVEEVIGNKPESDILVHT<br>AYDESTDENVMLLTSDAPEYKPWALVI<br>QDSNGENKIKML (SEQ ID NO: 389) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-4-R8)<br>MAERPFQCRICMRNFSQASNLISHIRTHTGEKPF<br>ACDICGRKFATSHSLTEHTKIHTGSQKPFQCRIC<br>MRNFSERSHLREHIRTHTGEKPFACDICGRKFA<br>QSGNLTEHTKIHTGEKPFQCRICMRKFASKKAL<br>TEHTKIHLR (SEQ ID NO: 408)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-10-R8 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSQASNLISHIRTHTGEKP<br>FACDICGRKFAQRANLRAHTKIHTGSQK<br>PFQCRICMRNFSQASNLISHIRTHTGEKP<br>FACDICGRKFATSHSLTEHTKIHTGEKPF<br>QCRICMRKFAERSHLREHTKIHLRGSGG<br>GGSGGSGGSAIPVKRGATGETKVFTGNS<br>NSPKSPTKGGCSGGSTNLSDIIEKETGKQ<br>LVIQESILMLPEEVEEVIGNKPESDILVHT<br>AYDESTDENVMLLTSDAPEYKPWALVI<br>QDSNGENKIKML (SEQ ID NO: 390) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-10-R8)<br>MAERPFQCRICMRNFSQASNLISHIRTHTGEKPF<br>ACDICGRKFAQRANLRAHTKIHTGSQKPFQCRI<br>CMRNFSQASNLISHIRTHTGEKPFACDICGRKFA<br>TSHSLTEHTKIHTGEKPFQCRICMRKFAERSHLR<br>EHTKIHLR (SEQ ID NO: 409)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| R13-1 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSRSDNLSTHIRTHTGEKP<br>FACDICGRKFADRSDLSRHTKIHTGEKPF<br>QCRICMRKFAQSGDLTRHTKIHTGSQKP<br>FQCRICMRNFSRSDSLSAHIRTHTGEKPF<br>ACDICGRKFAQKATRITHTKIHLRGSGG<br>GGSGGSGGSGSYALGPYQISAPQLPAYN<br>GQTVGTFYYVNDAGGLESKVFSSGGPT<br>PYPNYANAGHVEGQSALFMRDNGISEG<br>LVFHNNPEGTCGFCVNMTETLLPENAK | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (R13-1)<br>MAERPFQCRICMRNFSRSDNLSTHIRTHTGEKP<br>FACDICGRKFADRSDLSRHTKIHTGEKPFQCRIC |

-continued

| | | |
|---|---|---|
| | MTVVPPEGSGGSTNLSDIIEKETGKQLVI<br>QESILMLPEEVEEVIGNKPESDILVHTAY<br>DESTDENVMLLTSDAPEYKPWALVIQD<br>SNGENKIKML (SEQ ID NO: 391) | MRKFAQSGDLTRHTKIHTGSQKPFQCRICMRNF<br>SRSDSLSAHIRTHTGEKPFACDICGRKFAQKAT<br>RITHTKIHLR (SEQ ID NO: 410)<br>Linker<br>GSGGGGSGGSGGS (SEQ ID NO: 399)<br>Split DddA (DddA-G1397N)<br>GSYALGPYQISAPQLPAYNGQTVGTFYYVNDA<br>GGLESKVFSSGGPTPYPNYANAGHVEGQSALF<br>MRDNGISEGLVFHNNPEGTCGFCVNMTETLLP<br>ENAKMTVVPPEG (SEQ ID NO: 284)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-9-<br>R13 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSQSSSLVRHIRTHTGEKP<br>FACDICGRKFARSDNLVRHTKIHTGSQK<br>PFQCRICMRNFSQAGHLASHIRTHTGEK<br>PFACDICGRKFARKDNLKNHTKIHTGEK<br>PFQCRICMRKFARKDALRGHTKIHLRGS<br>GGGGSGGSGGSAIPVKRGATGETKVFT<br>GNSNSPKSPTKGGCSGGSTNLSDIIEKET<br>GKQLVIQESILMLPEEVEEVIGNKPESDI<br>LVHTAYDESTDENVMLLTSDAPEYKPW<br>ALVIQDSNGENKIKML (SEQ ID NO: 392) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-9-R13)<br>MAERPFQCRICMRNFSQSSSLVRHIRTHTGEKP<br>FACDICGRKFARSDNLVRHTKIHTGSQKPFQCR<br>ICMRNFSQAGHLASHIRTHTGEKPFACDICGRK<br>FARKDNLKNHTKIHTGEKPFQCRICMRKFARK<br>DALRGHTKIHLR (SEQ ID NO: 411)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |
| 5xZnF-12-<br>R13 v3 | MLGFVGRVAAAPASGALRRLTPSASLPP<br>AQLLLRAAPTAVHPVRDYAAQDYKDD<br>DDKVDEMTKKFGTLTIHDTEKAAMAER<br>PFQCRICMRNFSRSDHLTTHIRTHTGEKP<br>FACDICGRKFAQSSSLVRHTKIHTGSQKP<br>FQCRICMRNFSRSDNLVRHIRTHTGEKP<br>FACDICGRKFAQAGHLASHTKIHTGEKP<br>FQCRICMRKFARKDNLKNHTKIHLRGSG<br>GGGSGGSGGSAIPVKRGATGETKVFTG<br>NSNSPKSPTKGGCSGGSTNLSDIIEKETG<br>KQLVIQESILMLPEEVEEVIGNKPESDIL<br>VHTAYDESTDENVMLLTSDAPEYKPWA<br>LVIQDSNGENKIKML (SEQ ID NO: 393) | MTS<br>MLGFVGRVAAAPASGALRRLTPSASLPPAQLLL<br>RAAPTAVHPVRDYAAQ (SEQ ID NO: 394)<br>FLAG tag<br>DYKDDDDK (SEQ ID NO: 395)<br>NES<br>VDEMTKKFGTLTIHDTEK (SEQ ID NO: 396)<br>Linker<br>AA<br>ZF (5xZnF-12-R13)<br>MAERPFQCRICMRNFSRSDHLTTHIRTHTGEKP<br>FACDICGRKFAQSSSLVRHTKIHTGSQKPFQCRI<br>CMRNFSRSDNLVRHIRTHTGEKPFACDICGRKF<br>AQAGHLASHTKIHTGEKPFQCRICMRKFARKD<br>NLKNHTKIHLR (SEQ ID NO: 412)<br>Linker<br>GSGGGGSGGSGGS (SEQ ID NO: 399)<br>Split DddA (DddA-G1397C)<br>AIPVKRGATGETKVFTGNSNSPKSPTKGGC<br>(SEQ ID NO: 286)<br>Linker<br>SGGS (SEQ ID NO: 348)<br>UGI<br>TNLSDIIEKETGKQLVIQESILMLPEEVEEVIGNK<br>PESDILVHTAYDESTDENVMLLTSDAPEYKPW<br>ALVIQDSNGENKIKML (SEQ ID NO: 341) |

Optimisation of the ZF Scaffold Sequence Encompasses Two Separate Improvements

First, ZFs designed according to the Zif268 scaffold consisted of an N-terminal sequence (MAERP (SEQ ID NO: 421)), followed by a number of ZF repeats separated by linkers, and ended with a C-terminal sequence (HTKIHLR (SEQ ID NO: 422)). ZFs are typically composed of multiple ZF repeats, and each repeat will have a N-terminal scaffold half (FQCRICMRNFS (SEQ ID NO: 423) or FACDICGRKFA (SEQ ID NO: 424) or FQCRICMRKFA (SEQ ID NO: 425), a seven amino acid DNA-binding region, a C-terminal scaffold half (HIRTH (SEQ ID NO:

426) or HTKIH (SEQ ID NO: 427), and a linker (TGEKP (SEQ ID NO: 428) or TGQKP (SEQ ID NO: 429), or TGSQKP (SEQ ID NO: 430)). An example of this structure is noted below:

```
                                  (SEQ ID NO: 421)
MAERP

                                  (SEQ ID NO: 431)
FQCRICMRNFS...ZF1...HIRTH TGEKP

                                  (SEQ ID NO: 432)
FACDICGRKFA...ZF2...HTKIH TGSQKP

                                  (SEQ ID NO: 431)
FQCRICMRNFS...ZF3...HIRTH TGEKP

                                  (SEQ ID NO: 433)
FACDICGRKFA...ZF4...HTKIH TGEKP

                                  (SEQ ID NO: 434)
FQCRICMRKFA...ZF5...HTKIHLR
```

Wherein . . . ZF # . . . was replaced with seven amino acids (XXXXXXX) which specify the 3 bp DNA sequence to which this ZF repeat binds.

Improvements in ZF-BE editing efficiencies were only found in sequences that were scanned computationally to encode a weaker NLS. This implies designing ZFs such that every repeat will have an N-terminal scaffold half of FQCRICMRNFS (SEQ ID NO: 423) only, the seven amino acid DNA-binding region, a C-terminal scaffold half of HIRTH (SEQ ID NO: 426) only, and a linker of TGEKP (SEQ ID NO: 428) or TGSEKP (SEQ ID NO: 435) only. This strategy reduces the number of positively-charged residues (particularly Lys, K) which contribute to the inherent NLS of ZFs. As a result, the above example sequence would be converted into the sequence below, which produced improved levels of mitochondrial BE:

```
                                  (SEQ ID NO: 421)
MAERP

                                  (SEQ ID NO: 431)
FQCRICMRNFS...ZF1...HIRTH TGEKP

                                  (SEQ ID NO: 436)
FQCRICMRNFS...ZF2...HIRTH TGSEKP

                                  (SEQ ID NO: 431)
FQCRICMRNFS...ZF3...HIRTH TGEKP

                                  (SEQ ID NO: 431)
FQCRICMRNFS...ZF4...HIRTH TGEKP

                                  (SEQ ID NO: 437)
FQCRICMRNFS...ZF5...HTKIHLR
```

Second, within each ZF repeat, mutation of the FQCRICMRNFS (SEQ ID NO: 423) N-terminal scaffold half to FQCDICMRNFS (SEQ ID NO: 438) (a single R to D mutation in each repeat), removes a positively-charged amino acid and replaces it with a negatively-charged amino acid. This weakens the NLS inherently encoded within ZFs without disrupting its ability to bind to DNA.

In combination, these improvements are significant because they specify a way to construct not just ZFs but specifically mitochondrially-optimised ZFs for the first time. Previously. ZFs have been used for nuclear genome editing, or repurposed without any optimization (beyond addition of an MTS) for mitochondrial genome editing. However, these advancements represent optimisations being made to ZFs to specifically tailor their architecture towards mitochondrial genome editing—improving their activity by boosting mitochondrial localization and reducing nuclear localization without impairing the DNA-binding ability of the ZFs themselves.

Co-Expression and Targeting of an Additional Copy of UGI to the Mitochondria in Trans Previous BEs rely on inhibition of UDG, either in the nucleus or mitochondria, by fusion of one or multiple copies of UGI to the BE protein itself and act via colocalization. However, co-expression of additional copies of UGI as separate polypeptides (targeted to mitochondria via their own MTS) in order to suppress mitochondrial UDG to even lower levels has not previously been reported. This is an additional way to suppress mitochondrial UDG activity which can be applied to any mitochondrial BE (ZF- or TALE-based).

Figure 90A:
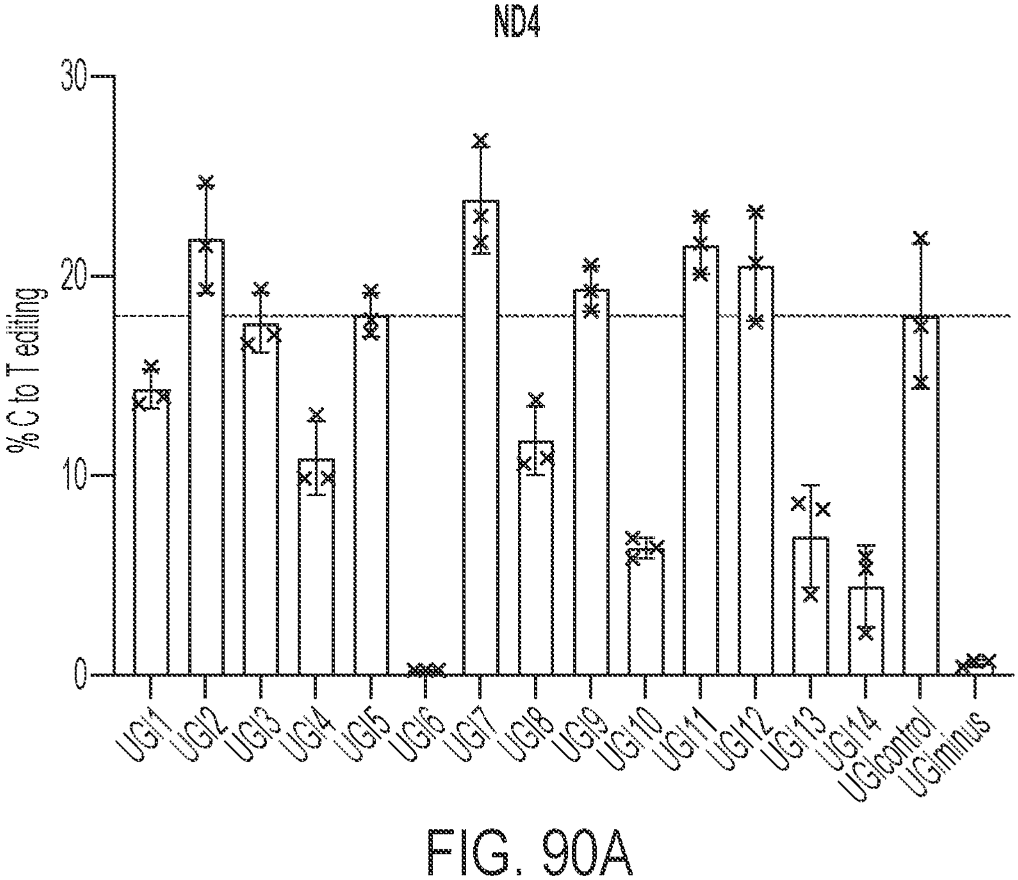
Figure 90B:
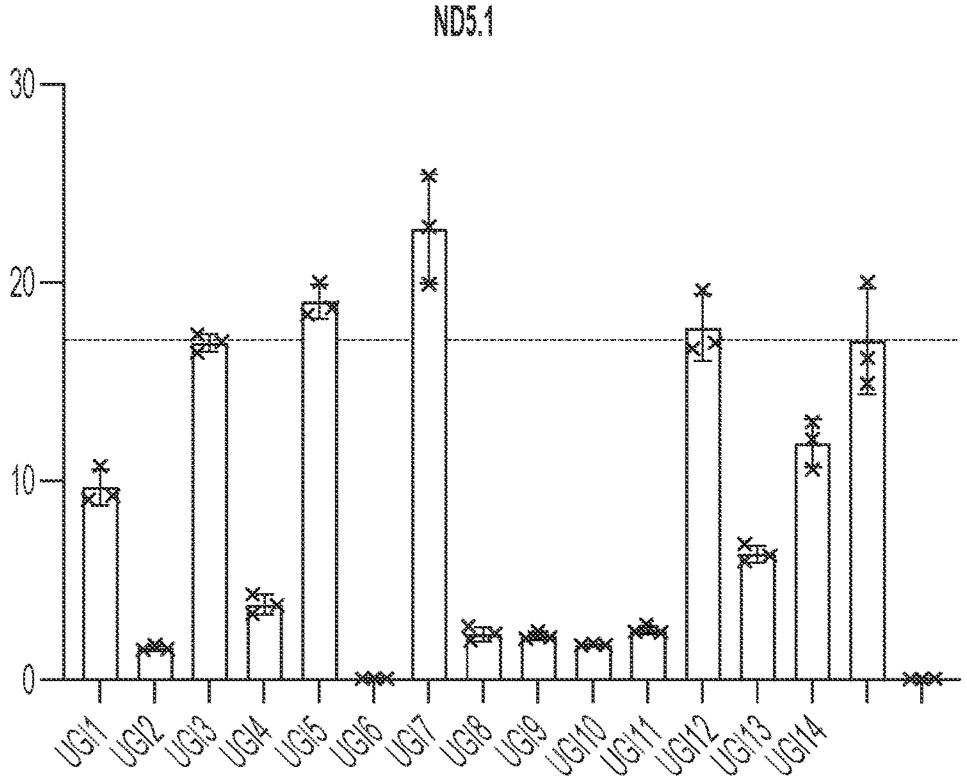
Figure 90C:
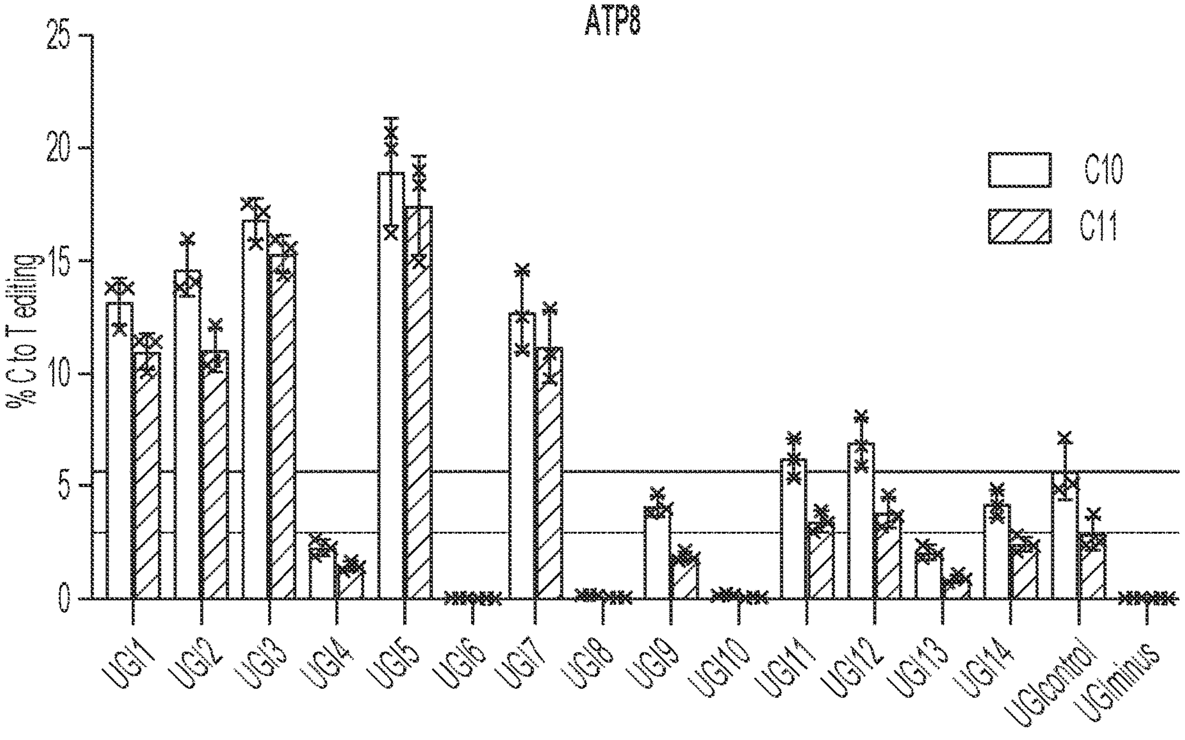
Figure 90D:
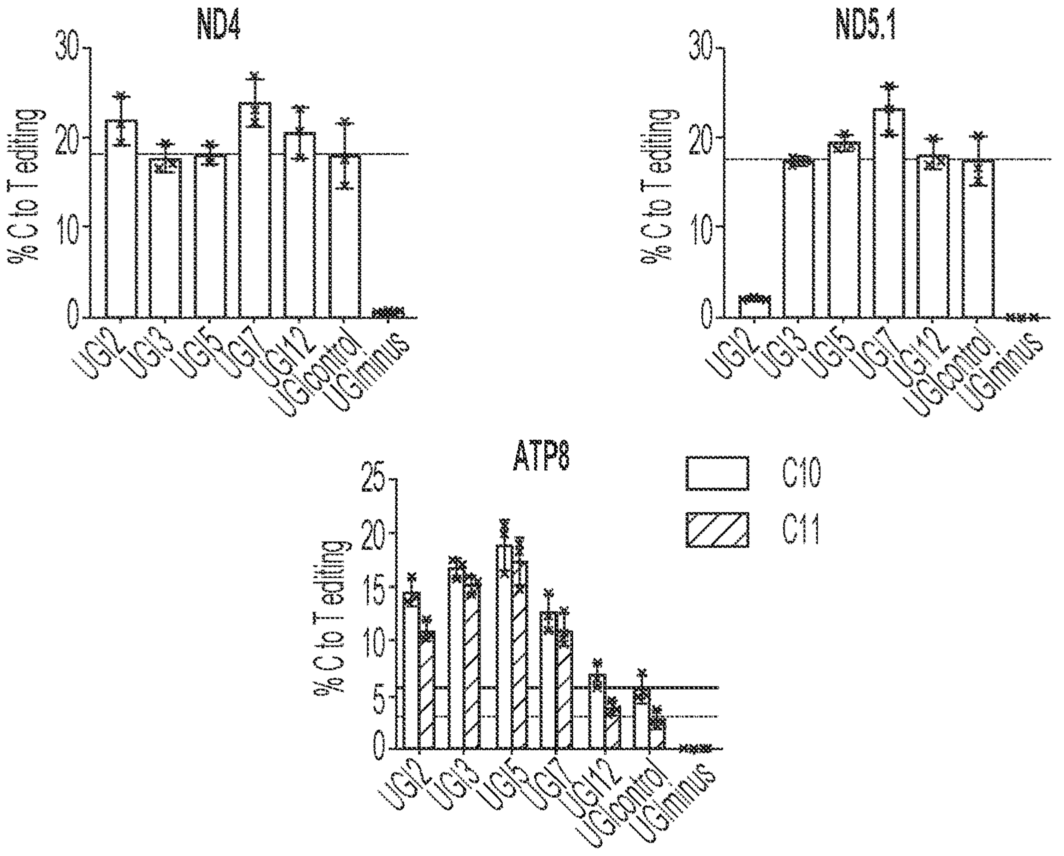
Figure 91A:
Figure 91B:
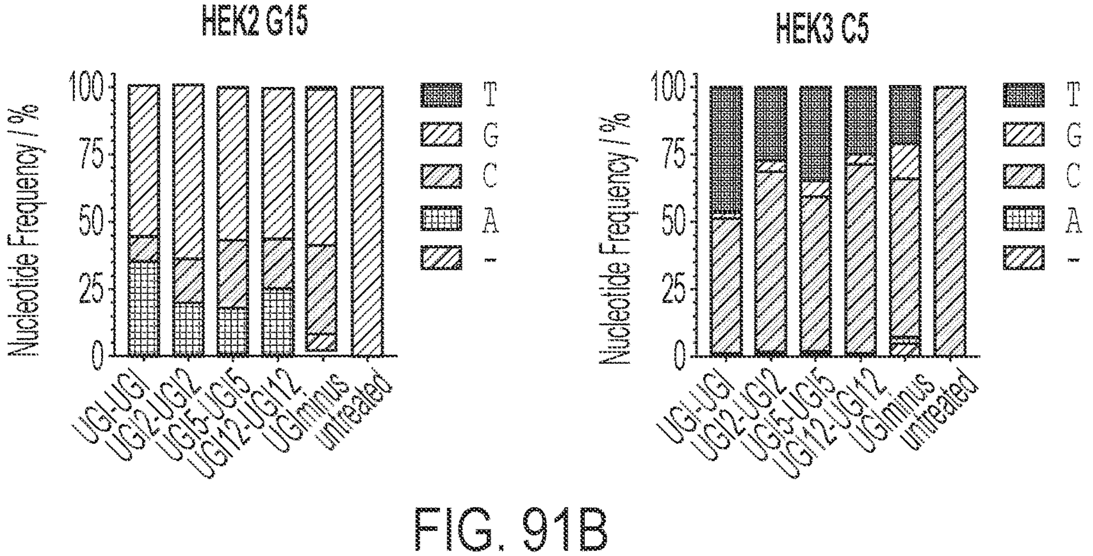
Figure 91C:
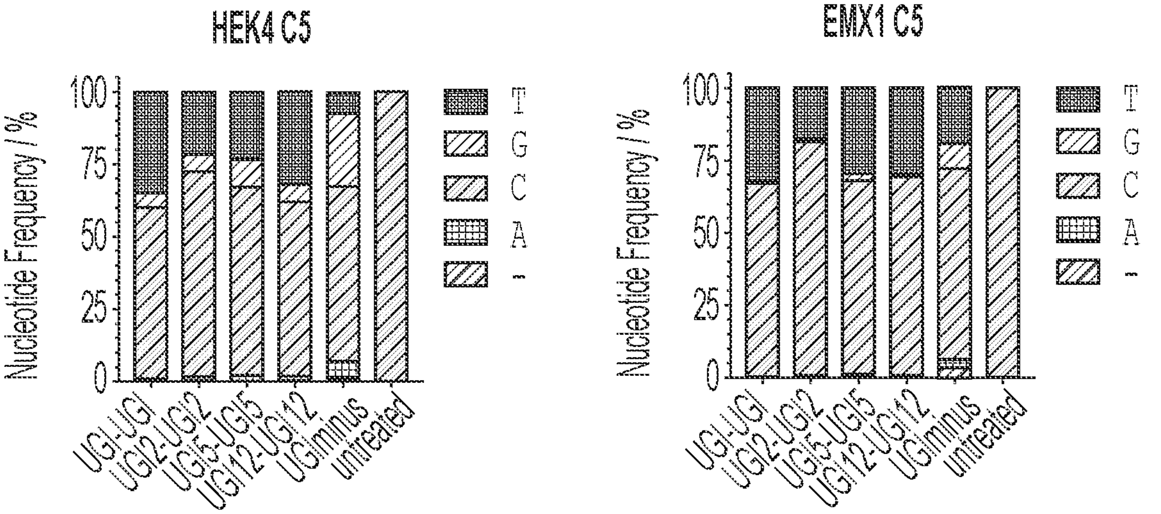
Figure 91D:
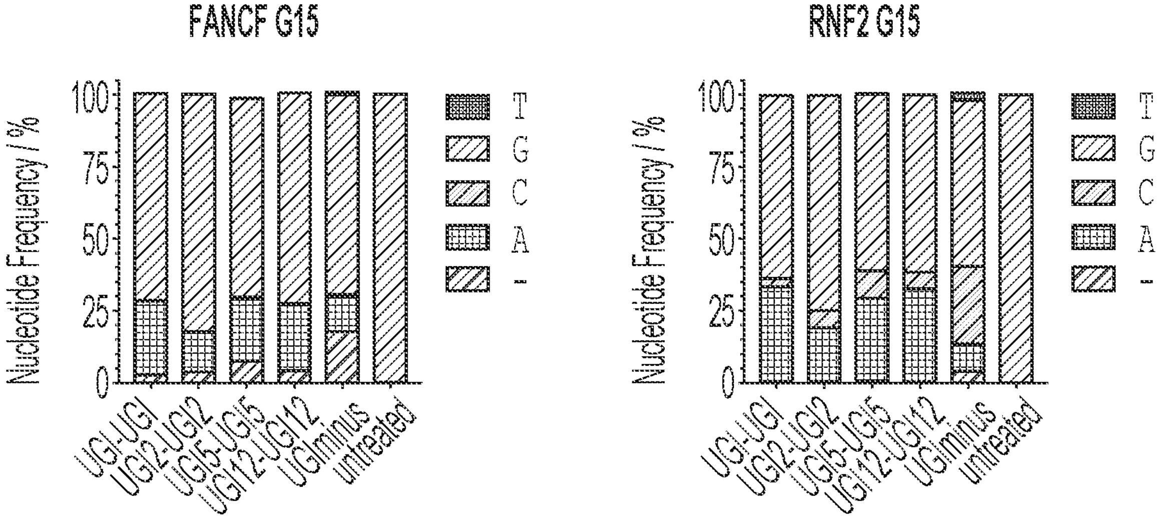

Example 6. Tale-DdCBE Mitochondrial Base Editing with Alternative UGI Homologs New UGI homologs were identified by computational search for homology to known UGI proteins, namely from bacteriophage PBS2, bacteriophage phi29 and *S. aureus*, in addition to literature review (see UGI2 below). These newly-identified UGI homologs were tested for their ability to inhibit mitochondrial UDG in the context of TALE-DdCBEs (FIG. 88). Three different sites were chosen, reflecting high (ND4), medium (ND5.1) and low (ATP8) editing efficiencies to establish if the observed effects were consistent across different sites (FIG. 89). The best performing homologs were UG 15 and UGI 17, and lead to robust improvements in editing efficiencies across different sites in the context of TALE-DdCBE (FIGS. 90A-90C) Five UGI homologs were deemed to show relative improvements over the canonical UGI (from bacteriophage PBS2) typically used in BE experiments (FIGS. 90A-90D). The following sequences were used in the context of TALE-DdCBEs, replacing the normal (canonical) UGI sequence following the DddA split deaminase and SGGS linker as shown in FIG. 90D. Note that UGI12 was predicted to exist as a homodimer and to bind to UDG in this homodimeric form. Therefore, UGI2 was tested as two UGI12 monomers linked in tandem together via a flexible linker. However, given the predicted nature of the homodimeric structure (each monomer binding antiparallel to the other), it was required to fuse one monomer of UGI 12 to a circularly-permuted version of another monomer of UGI12.

| UGI | Sequence | SEQ ID NO: |
|---|---|---|
| Canonical UGI | TNLSDIIEKETGKQLVIQESILMLPEEVEEVIGNKPESDILVHTAYDE STDENVMLLTSDAPEYKPWALVIQDSNGENKIKML | 341 |
| UGI2 | MTLELQLKHYITNLFNLPKDEKWHCESIEEIADDILPDQYVRLGAL SNKILQTYTYYSDTLHESNIYPFILYYQKQLIAIGYIDENHDMDFLY LHNTIMPLLDQRYLLTGGQ | 445 |

-continued

| UGI | Sequence | SEQ ID NO: |
|---|---|---|
| UGI 3 | MNKNFDEVKADLRTVTGKKIEFKERLKNILRVQMNQLGFEDSYMI QVQVSSDQEEWVECHENMSLSDFEVMYGNISGEIKRMTVVKYEE ANIEKLVELKFEYEYAKAHQEYIRAYTKLMSNTLYGRKPSL | 446 |
| UGI5 | MNEEKMHYRDAIKEVELTMMSLDSHFRTHKEFTDSYLLVLILEDV VGETRVEVSEGLTFDEASYIIGGTSDNILNMHMINYCEKNREEIYK WLKVSRVNTFKSNYAKMLLNTAYGKDLLKGVVK | 447 |
| UGI7 | MNNHFMSIGRNCSKCNNVRLNEDFSKSEEICNECFDKEERFVDSY TLIYITEDETGKRFEAILENQTIEETEIIYGNIIDKIIVWNVILTM | 375 |
| UGI12 | DGNEHWEVHPGLSLSDFEVVYGNNPHQIVKLRLDKEVGGSGGSM VQNDFIDSYTLCWLLRDDSGGGGSMVQNDFIDSYTLCWLLRDDD GNEHWEVHPGLSLSDFEVVYGNNPHQIVKLRLDKEV | 376 |
| UGI12 Monomer 1-C | DGNEHWEVHPGLSLSDFEVVYGNNPHQIVKLRLDKEV | 439 |
| UGI12 Monomer 1-C Linker | GGSGGS | 440 |
| UGI12 Monomer 2-N | MVQNDFIDSYTLCWLLRDD | 441 |
| UGI12 Monomer 2-N Linker | SGGGGS | 442 |
| UGI12 Monomer 2 | MVQNDFIDSYTLCWLLRDDDGNEHWEVHPGLSLSDFEVVYGNNP HQIVKLRLDKEV | 443 |

Three of the top perfoming UGI homologs were tested in the context of BE4 max. The remaining two were unable to be cloned in the BE4max architecture as they were toxic to *E. coli* in UGI-UGI (BE4max) architecture. However, results show that the UGI homologs did not improve editing efficiency in BE4max (FIGS. 91A-91D.)

REFERENCES

The following references are each incorporated herein by reference in their entireties.

1. Jinek, M, et al. A Programmable Dual-RNA-Guided DNA Endonuclease in Adaptive Bacterial Immunity. *Science* 337, 816-821 (2012).
2. Cong, L, et al. Multiplex Genome Engineering Using CRISPR/Cas Systems. *Science* 339. 819-823 (2013).
3. Komor, A. C., Badran, A. H. & Liu, D. R. CRISPR-Based Technologies for the Manipulation of Eukaryotic Genomes. *Cell* 168, 20-36 (2017).
4. Komor, A. C., Kim, Y. B., Packer. M. S., Zuris. J. A. & Liu, D. R. Programmable editing of a target base in genomic DNA without double-stranded DNA cleavage. *Nature* 533, 420-424 (2016).
5. Nishida, K, et al. Targeted nucleotide editing using hybrid prokaryotic and vertebrate adaptive immune systems. *Science* 353, aaf8729 (2016).
6. Gaudelli, N. M, et al. Programmable base editing of A•T to G•C in genomic DNA without DNA cleavage. *Nature* 551, 464-471 (2017).
7. ClinVar, July 2019.
8. Dunbar, C. E, et al. Gene therapy comes of age. *Science* 359, eaan4672 (2018).
9. Cox. D. B. T., Platt, R. J. & Zhang, F. Therapeutic genome editing: prospects and challenges. *Nat. Med.* 21, 121-131 (2015).
10. Adli, M. The CRISPR tool kit for genome editing and beyond. *Nat. Commun.* 9, 1911 (2018).
11. Kleinstiver, B. P, et al. Engineered CRISPR-Cas9 nucleases with altered PAM specificities. *Nature* 523, 481-485 (2015).
12. Kleinstiver, B. P, et al. High-fidelity CRISPR-Cas9 nucleases with no detectable genome-wide off-target effects. *Nature* 529, 490-495 (2016).
13. Hu, J. H, et al. Evolved Cas9 variants with broad PAM compatibility and high DNA specificity. *Nature* 556, 57-63 (2018).
14. Nishimasu, H, et al. Engineered CRISPR-Cas9 nuclease with expanded targeting space. *Science* 361, 1259-1262 (2018).
15. Jasin, M. & Rothstein, R. Repair of strand breaks by homologous recombination. *Cold Spring Harb. Perspect. Biol.* 5, a012740 (2013).
16. Paquet, D, et al. Efficient introduction of specific homozygous and heterozygous mutations using CRISPR/Cas9. *Nature* 533, 125-129 (2016).
17. Kosicki, M., Tomberg, K. & Bradley. A. Repair of double-strand breaks induced by CRISPR-Cas9 leads to large deletions and complex rearrangements. *Nat. Biotechnol.* 36, 765-771 (2018).
18. Haapaniemi. E., Botla, S., Persson, J., Schmierer, B. & Taipale, J. CRISPR-Cas9 genome editing induces a p53-mediated DNA damage response. *Nat. Med.* 24, 927-930 (2018).
19. Ihry. R. J, et al. p53 inhibits CRISPR-Cas9 engineering in human pluripotent stem cells. *Nat. Med.* 24, 939-946 (2018).
20. Richardson, C. D., Ray, G. J., DeWitt, M. A., Curie. G. L. & Corn, J. E. Enhancing homology-directed genome editing by catalytically active and inactive CRISPR-Cas9 using asymmetric donor DNA. *Nat. Biotechnol.* 34, 339-344 (2016).

21. Srivastava, M, et al. An Inhibitor of Nonhomologous End-Joining Abrogates Double-Strand Break Repair and Impedes Cancer Progression. *Cell* 151. 1474-1487 (2012).
22. Chu, V. T, et al. Increasing the efficiency of homology-directed repair for CRISPR-Cas9-induced precise gene editing in mammalian cells. *Nat. Biotechnol.* 33, 543-548 (2015).
23. Maruyama, T, et al. Increasing the efficiency of precise genome editing with CRISPR-Cas9 by inhibition of non-homologous end joining. *Nat. Biotechnol.* 33, 538-542 (2015).
24. Kim. Y. B, et al. Increasing the genome-targeting scope and precision of base editing with engineered Cas9-cytidine deaminase fusions. *Nat. Biotechnol.* 35, 371-376 (2017).
25. Li. X, et al. Base editing with a Cpf1-cytidine deaminase fusion. *Nat. Biotechnol.* 36. 324-327 (2018).
26. Gehrke, J. M, et al. An APOBEC3A-Cas9 base editor with minimized bystander and off-target activities. *Nat. Biotechnol*. (2018). doi:10.1038/nbt.4199
27. Rees, H. A. & Liu, D. R. Base editing: precision chemistry on the genome and transcriptome of living cells. *Nat. Rev. Genet.* 1 (2018). doi:10.1038/s41576-018-0059-1.
28. Ostertag. E. M. & Kazazian Jr, H. H. Biology of Mammalian L1 Retrotransposons. *Annu. Rev. Genet.* 35, 501-538 (2001).
29. Zimmerly, S., Guo, H., Perlman. P. S. & Lambowltz, A. M. Group II intron mobility occurs by target DNA-primed reverse transcription. *Cell* 82, 545-554 (1995).
30. Luan, D. D., Korman, M. H., Jakubczak, J. L. & Eickbush, T. H. Reverse transcription of R2Bm RNA is primed by a nick at the chromosomal target site: a mechanism for non-LTR retrotransposition. *Cell* 72, 595-605 (1993).
31. Feng, Q., Moran, J. V., Kazazian, H. H. & Boeke, J. D. Human L1 retrotransposon encodes a conserved endonuclease required for retrotransposition. *Cell* 87, 905-916 (1996).
32. Jinek, M, et al. Structures of Cas9 Endonucleases Reveal RNA-Mediated Conformational Activation. *Science* 343, 1247997 (2014).
33. Jiang. F, et al. Structures of a CRISPR-Cas9 R-loop complex primed for DNA cleavage. *Science* aad8282 (2016). doi:10.1126/science.aad8282
34. Qi, L. S, et al. Repurposing CRISPR as an RNA-Guided Platform for Sequence-Specific Control of Gene Expression. *Cell* 152, 1173-1183 (2013).
35. Tang, W., Hu, J. H. & Liu, D. R. Aptazyme-embedded guide RNAs enable ligand-responsive genome editing and transcriptional activation. *Nat. Commun.* 8, 15939 (2017).
36. Shechner. D. M., Hacisuleyman, E., Younger, S. T. & Rinn, J. L. Multiplexable, locus-specific targeting of long RNAs with CRISPR-Display. *Nat. Methods* 12, 664-670 (2015).
37. Anders, C. & Jinek. M. Chapter One—In vitro Enzymology of Cas9. in *Methods in Enzymology* (eds. Doudna, J. A. & Sontheimer. E. J.) 546, 1-20 (Academic Press, 2014).
38. Briner, A. E, et al. Guide RNA Functional Modules Direct Cas9 Activity and Orthogonality. *Mol. Cell* 56. 333-339 (2014).
39. Nowak, C. M., Lawson, S., Zerez, M. & Bleris, L. Guide RNA engineering for versatile Cas9 functionality. *Nucleic Acids Res.* 44, 9555-9564 (2016).
40. Sternberg, S. H., Redding. S., Jinek, M., Greene, E. C. & Doudna, J. A. DNA interrogation by the CRISPR RNA-guided endonuclease Cas9. *Nature* 507, 62-67 (2014).
41. Mohr, S, et al. Thermostable group II intron reverse transcriptase fusion proteins and their use in cDNA synthesis and next-generation RNA sequencing. *RNA* 19, 958-970 (2013).
42. Stamos. J. L., Lentzsch, A. M. & Lambowitz, A. M. Structure of a Thermostable Group II Intron Reverse Transcriptase with Template-Primer and Its Functional and Evolutionary Implications. *Mol. Cell* 68, 926-939.e4 (2017).
43. Zhao, C. & Pyle, A. M. Crystal structures of a group II intron maturase reveal a missing link in spliceosome evolution. *Nat. Struct. Mol. Biol.* 23, 558-565 (2016).
44. Zhao, C., Liu, F. & Pyle, A. M. An ultraprocessive, accurate reverse transcriptase encoded by a metazoan group II intron. *RNA* 24, 183-195 (2018).
45. Ran, F. A, et al. Genome engineering using the CRISPR-Cas9 system. *Nat. Protoc.* 8, 2281-2308 (2013).
46. Liu, Y., Kao, H.-I. & Bambara. R. A. Flap endonuclease 1: a central component of DNA metabolism. *Annu. Rev. Biochen.* 73, 589-615 (2004).
47. Krokan, H. E. & Bjsris, M. Base Excision Repair. *Cold Spring Harb. Perspect. Biol.* 5. (2013).
48. Kelman, Z. PCNA: structure, functions and interactions. *Oncogene* 14, 629-640 (1997).
49. Choe, K. N. & Moldovan, G.-L. Forging Ahead through Darkness: PCNA, Still the Principal Conductor at the Replication Fork. *Mol. Cell* 65, 380-392 (2017).
50. Li, X., Li. J., Harrington, J., Lieber, M. R. & Burgers, P. M. Lagging strand DNA synthesis at the eukaryotic replication fork involves binding and stimulation of FEN-1 by proliferating cell nuclear antigen. *J. Biol. Chem.* 270, 22109-22112 (1995).
51. Tom, S., Henricksen, L. A. & Bambara, R. A. Mechanism whereby proliferating cell nuclear antigen stimulates flap endonuclease 1. *J. Biol. Chem.* 275, 10498-10505 (2000).
52. Tanenbaum, M. E., Gilbert, L. A., Qi. L. S., Weissman, J. S. & Vale, R. D. A protein-tagging system for signal amplification in gene expression and fluorescence imaging. *Cell* 159. 635-646 (2014).
53. Bertrand, E, et al. Localization of ASHI mRNA particles in living yeast. *Mol. Cell* 2, 437-445 (1998).
54. Dahlman. J. E, et al. Orthogonal gene knockout and activation with a catalytically active Cas9 nuclease. *Nat. Biotechnol.* 33, 1159-1161 (2015).
55. Tsai, S. Q, et al. GUIDE-seq enables genome-wide profiling off-target cleavage by CRISPR-Cas nucleases. *Nat. Biotechnol.* 33, 187-197 (2015).
56. Tsai, S. Q, et al. CIRCLE-seq: a highly sensitive in vitro screen for genome-wide CRISPR-Cas9 nuclease off-targets. *Nat. Methods* 14, 607-614 (2017).
57. Schek N. Cooke C. Alwine J C. Molecular and Cellular Biology. (1992).
58. Gil A, Proudfoot N J. Cell. (1987).
59. Zhao, B. S., Roundtree, I. A., He, C. Nat Rev Mol Cell Biol. (2017).
60. Rubio, M. A. T., Hopper, A. K. Wiley Interdiscip Rev RNA (2011).
61. Shechner. D. M., Hacisuleyman E., Younger, S. T., Rinn, J. L. Nat Methods. (2015).
62. Paige, J. S., Wu. K. Y., Jaffrey, S.R. Science (2011).
63. Ray D., . . . Hughes T R. Nature (2013).

64. Chadalavada. D. M., Cerrone-Szakal, A. L., Bevilacqua, P. C. RNA (2007).
65. Forster A C, Symons R H. Cell. (1987).
66. Weinberg Z, Kim P B, Chen T H, Li S, Harris K A, LOlnse C E, Breaker R R. Nat. Chem. Biol. (2015).
67. Feldstein P A. Buzayan J M, Bruening G. Gene (1989).
68. Saville B J, Collins R A. Cell. (1990).
69. Winkler W C, Nahvi A, Roth A, Collins J A, Breaker R R. Nature (2004).
70. Roth A. Weinberg Z, Chen A G. Kim P G, Ames T D, Breaker R R. Nat Chem Biol. (2013).
71. Choudhury R, Tsai Y S, Dominguez D, Wang Y, Wang Z. Nat Commun. (2012).
72. MacRae U, Doudna J A. Curr Opin Struct Biol. (2007).
73. Bernstein E. Caudy A A, Hammond S M, Hannon G J Nature (2001).
74. Filippov V. Solovyev V, Filippova M. Gill S S. Gene (2000).
75. Cadwell R C and Joyce G F. PCR Methods Appl. (1992).
76. McInerney P. Adams P, and Hadi M Z. Mol Biol Int. (2014).
77. Esvelt K M, Carlson J C, and Liu D R. Nature. (2011).
78. Naorem S S, Hin J, Wang S. Lee W R, Heng X, Miller J F, Guo H. Proc Natd Acad Sci USA (2017).
79. Martinez M A, Vartanian J P, Wain-Hobson S. Proc Natd Acad Sci USA (1994).
80. Meyer A J, Ellefson J W, Ellington A D. Curr Protoc Mol Biol. (2014).
81. Wang H H, Isaacs F J, Carr P A, Sun Z Z, Xu G, Forest C R, Church G M. Nature. (2009).
82. Nyerges Á et al. Proc Natd Acad Sci USA. (2016).
83. Mascola J R. Haynes B F. Immunol Rev. (2013).
84. X. Wen, K. Wen. D. Cao. G. Li, R. W. Jones, J. Li, S. Szu. Y. Hoshino, L. Yuan, Inclusion of a universal tetanus toxoid CD4(+) T cell epitope P2 significantly enhanced the immunogenicity of recombinant rotavirus ΔVP8* subunit parenteral vaccines. Vaccine 32, 4420-4427 (2014).
85. G. Ada, D. Isaacs. Carbohydrate-protein conjugate vaccines. Clin Microbiol Infect 9, 79-85 (2003).
86. E. Malito, B. Bursulaya, C. Chen, P. L. Surdo, M. Picchianti, E. Balducci, M. Biancucci, A. Brock, F. Berti, M. J. Bottomley, M. Nissum, P. Costantino, R. Rappuoli, G. Spraggon, Structural basis for lack of toxicity of the diphtheria toxin mutant CRM197. Proceedings of the National Academy of Sciences 109, 5229 (2012).
87. J. de Wit, M. E. Emmelot, M. C. M. Poelen. J. Lanfermeijer, W. G. H. Han. C. van Els, P. Kaaijk, The Human CD4(+) T Cell Response against Mumps Virus Targets a Broadly Recognized Nucleoprotein Epitope. J Virol 93, (2019).
88. M. May. C. A. Rieder, R. J. Rowe, Emergent lineages of mumps virus suggest the need for a polyvalent vaccine. Int J Infect Dis 66. 1-4 (2018).
89. M. Ramamurthy, P. Rajendiran, N. Saravanan, S. Sankar, S. Gopalan, B. Nandagopal, Identification of immunogenic B-cell epitope peptides of rubella virus E1 glycoprotein towards development of highly specific immunoassays and/or vaccine. Conference Abstract. (2019).
90. U. S. F. Tambunan, F. R. P. Sipahutar. A. A. Parikesit, D. Kerami, Vaccine Design for H5N1 Based on B- and T-cell Epitope Predictions. Bioinform Biol Insights 10. 27-35 (2016).
91. Asante, E A. et. al. "A naturally occurring variant of the human prion protein completely prevents prion disease". Nature. (2015).
92. Crabtree. G. R. & Schreiber, S. L. Three-part inventions: intracellular signaling and induced proximity. *Trends Biochem. Sci.* 21, 418-22 (1996).
93. Liu, J, et al. Calcineurin Is a Common Target of A and FKBP-FK506 Complexes. *Cell* 66, 807-815 (1991).
94. Keith, C. T, et al. A mammalian protein targeted by G1-arresting rapamycin-receptor complex. *Nature* 369, 756-758 (2003).
95. Spencer, D. M., Wandless, T. J., Schreiber, S. L. S. & Crabtree, G. R. Controlling signal transduction with synthetic ligands. *Science* 262, 1019-24 (1993).
96. Pruschy, M. N, et al. Mechanistic studies of a signaling pathway activated by the organic dimerizer FK1012. *Chem. Biol.* 1. 163-172 (1994).
97. Spencer, D. M, et al. Functional analysis of Fas signaling in vivo using synthetic inducers of dimerization. *Curr. Biol.* 6, 839-847 (1996).
98. Belshaw, P. J., Spencer, D. M., Crabtree, G. R. & Schreiber. S. L. Controlling programmed cell death with a cyclophilin-cyclosporin-based chemical inducer of dimerization. *Chem. Biol.* 3, 731-738 (1996).
99. Yang, J. X., Symes, K., Mercola, M. & Schreiber, S. L. Small-molecule control of insulin and PDGF receptor signaling and the role of membrane attachment. *Curr. Biol.* 8, 11-18 (1998).
100. Belshaw, P. J., Ho. S. N., Crabtree, G. R. & Schreiber, S. L. Controlling protein association and subcellular localization with a synthetic ligand that induces heterodimerization of proteins. *Proc. Natl. Acad. Sci.* 93, 4604-4607 (2002).
101. Stockwell. B. R. & Schreiber, S. L. Probing the role of homomeric and heteromeric receptor interactions in TGF-β signaling using small molecule dimerizers. *Curr. Biol.* 8, 761-773 (2004).
102. Spencer, D. M., Graef, I., Austin, D. J., Schreiber, S. L. & Crabtree, G. R. A general strategy for producing conditional alleles of Src-like tyrosine kinases. *Proc. Natl. Acad. Sci.* 92. 9805-9809 (2006).
103. Holsinger, L. J., Spencer, D. M., Austin, D. J., Schreiber, S. L. & Crabtree. G. R. Signal transduction in T lymphocytes using a conditional allele of Sos. *Proc. Natd. Acad. Sci.* 92, 9810-9814 (2006).
104. Myers. M. G. Insulin Signal Transduction and the IRS Proteins. *Annu. Rev. Phamacol. Toxicol.* 36. 615-658 (1996).
105. Watowich, S. S. The erythropoietin receptor: Molecular structure and hematopoietic signaling pathways. *J. Investig. Med.* 59, 1067-1072 (2011).
106. Blau. C. A., Peterson, K. R., Drachman, J. G. & Spencer, D. M. A proliferation switch for genetically modified cells. *Proc. Natl. Acad. Sci.* 94, 3076-3081 (2002).
107. Clackson. T, et al. Redesigning an FKBP-ligand interface to generate chemical dimerizers with novel specificity. *Proc. Natl. Acad. Sci.* 95, 10437-10442 (1998).
108. Diver, S. T. & Schreiber, S. L. Single-step synthesis of cell-permeable protein dimerizers that activate signal transduction and gene expression. *J. Am. Chem. Soc.* 119, 5106-5109 (1997).
109. Guo, Z. F., Zhang, R. & Liang, F. Sen. Facile functionalization of FK506 for biological studies by the thiol-ene 'click' reaction. *RSC Adv.* 4, 11400-11403 (2014). Robinson, D. R., Wu, Y.-M. & Lin, S.-F. The protein tyrosine kinase family of the human genome. *Oncogene* 19, 5548-5557 (2000).

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

SEQUENCE LISTING (646 sequences)

SEQ ID NO: 1 - protein, 676 aa, Artificial Sequence
  Synthetic
MALSRAVCGTSRQLAPVLGYLGSRQKHSLPDYPYDVPDYAGYPYDVPDYAGYPYDVPDYAMDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEG

SEQ ID NO: 2 - protein, 856 aa, Artificial Sequence
  Synthetic
MALSRAVCGTSRQLAPVLGYLGSRQKHSLPDYPYDVPDYAGYPYDVPDYAGYPYDVPDYATNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSMDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEG

SEQ ID NO: 3 - protein, 856 aa, Artificial Sequence
  Synthetic
MALSRAVCGTSRQLAPVLGYLGSRQKHSLPDYPYDVPDYAGYPYDVPDYAGYPYDVPDYAMDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKML

SEQ ID NO: 4 - protein, 763 aa, Artificial Sequence
  Synthetic
MALSRAVCGTSRQLAPVLGYLGSRQKHSLPDYPYDVPDYAGYPYDVPDYAGYPYDVPDYATNLSDIIEKETGKQLVIQESILMLPEEVEEVIGNKPESDILVHTAYDESTDENVMLLTSDAPEYKPWALVIQDSNGENKIKMLSGGSMDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEG

SEQ ID NO: 5 - protein, 763 aa, Artificial Sequence
  Synthetic
MALSRAVCGTSRQLAPVLGYLGSRQKHSLPDYPYDVPDYAGYPYDVPDYAGYPYDVPDYAMDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKML

SEQ ID NO: 6 - protein, 624 aa, Artificial Sequence
  Synthetic
MASVLTPLLLRGLTGSARRLPVPRAKIHSLDYKDHDGDYKDHDIDYKDDDDKMDIADLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSAIPVKRGATGETKVFTGNSNSPKSPTKGGC

SEQ ID NO: 7 - protein, 804 aa, Artificial Sequence
  Synthetic
MASVLTPLLLRGLTGSARRLPVPRAKIHSLDYKDHDGDYKDHDIDYKDDDDKTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSMDIADLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSAIPVKRGATGETKVFTGNSNSPKSPTKGGC

SEQ ID NO: 8 - protein, 804 aa, Artificial Sequence
  Synthetic
MASVLTPLLLRGLTGSARRLPVPRAKIHSLDYKDHDGDYKDHDIDYKDDDDKMDIADLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKML

SEQ ID NO: 9 - protein, 711 aa, Artificial Sequence
  Synthetic
MASVLTPLLLRGLTGSARRLPVPRAKIHSLDYKDHDGDYKDHDIDYKDDDDKTNLSDIIEKETGKQLVIQESILMLPEEVEEVIGNKPESDILVHTAYDESTDENVMLLTSDAPEYKPWALVIQDSNGENKIKMLSGGSMDIADLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSAIPVKRGATGETKVFTGNSNSPKSPTKGGC

SEQ ID NO: 10 - protein, 711 aa, Artificial Sequence
  Synthetic
MASVLTPLLLRGLTGSARRLPVPRAKIHSLDYKDHDGDYKDHDIDYKDDDDKMDIADLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 11 - protein, 607 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASHDGGKQALETVQRLLPVLCQAHGLTPEQVVAIASNGGGKQALETVQRLLPVLCQAHGLTPQQVVAIASNGGGKQALETVQRLLPVLCQAHGLTPEQVVAIASNGGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQRLLPVLCQAHGLTPEQVVAIASNNGGKQALETVQRLLPVLCQAHGLTPQQVVAIASNIGGKQALETVQRLLPVLCQAHGLTPQQVVAIASNIGGRPALESIVAQLSRPDPALAALTNDHLVALACLGGRPALDAVKKGLG

SEQ ID NO: 12 - protein, 573 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNIGGKQALETVQRLLPVLCQAHGLTPEQVVAIASNGGGKQALETVQRLLPVLCQAHGLTPQQVVAIASNNGGKQALETVQRLLPVLCQAHGLTPEQVVAIASNNGGKQALETVQALLPVLCQAHGLTPQQVVAIASNNGGKQALETVQRLLPVLCQAHGLTPQQVVAIASHDGGKQALETVQRLLPVLCQAHGLTPEQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPQQVVAIASNGGGRPALESIVAQLSRPDPALAALTNDHLVALACLGGRPALDAVKKGLG

SEQ ID NO: 13 - protein, 30 aa, Artificial Sequence
  Synthetic
MLSRAVCGTSRQLAPVLGYLGSRQKHSLPD

SEQ ID NO: 14 - protein, 29 aa, Artificial Sequence
  Synthetic
MSVLTPLLLRGLTGSARRLPVPRAKIHSL

SEQ ID NO: 15 - DNA, 214 bp, Artificial Sequence
  Synthetic
accacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaa

SEQ ID NO: 16 - DNA, 214 bp, Artificial Sequence; identical to SEQ ID NO: 15
  Synthetic

SEQ ID NO: 17 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 18 - protein, 413 aa, Artificial Sequence
  Synthetic
CLAEGTRIFDPVTGTTHRIEDVVDGRKPIHVVAVAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYTNVVPLYDLLLEMLDAHRLHAGGSGASRVQAFADALDDKFLHDMLAEELRYSVIREVLPTRRARTFDLEVEELHTLVAEGVVVHNC

SEQ ID NO: 19 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 20 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 21 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 22 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYNPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 23 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 24 - protein, 413 aa, Artificial Sequence
  Synthetic
CLAEGTRIFDPVTGTTHRIEDVVDGRKPIHVVAVAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 25 - DNA, 33 bp, Artificial Sequence
  Synthetic
gccaacatgaggatcacccatgtctgcagggcc

SEQ ID NO: 26 - protein, 131 aa, Artificial Sequence
  Synthetic
GSASNFTQFVLVDNGGTGDVTVAPSNFANGVAEWISSNSRSQAYKVTCSVRQSSAQNRKYTIKVEVPKVATQTVGGEELPVAGWRSYLNMELTIPIFATNSDCELIVKAMQGLLKDGNPIPSAIAANSGIY

SEQ ID NO: 27 - protein, 84 aa, Artificial Sequence
  Synthetic
MTNLSDIIEKETGKQLVIQESILMLPEEVEEVIGNKPESDILVHTAYDESTDENVMLLTSDAPEYKPWALVIQDSNGENKIKML

SEQ ID NO: 28 - protein, 1368 aa, Streptococcus pyogenes [sequence omitted]

SEQ ID NO: 29 - DNA, 4104 bp, Streptococcus pyogenes
atggataaaaaatatagcattggcctggatattggcaccaacagcgtgggctgggcggtgattaccgatgaatataaagtgccgagcaaaaaatttaaagtgctgggcaacaccgatcgccatagcattaaaaaaaacctgattggcgcgctgctgtttgatagcggcgaaaccgcggaagcgacccgcctgaaacgcaccgcgcgccgccgctatacccgccgcaaaaaccgcatttgctatctgcaggaaatttttagcaacgaaatggcgaaagtggatgatagcttttttcatcgcctggaagaaagctttctggtggaagaagataaaaaacatgaacgccatccgatttttggcaacattgtggatgaagtggcgtatcatgaaaaatatccgaccatttatcatctgcgcaaaaaactggtggatagcaccgataaagcggatctgcgcctgatttatctggcgctggcgcatatgattaaatttcgcggccattttctgattgaaggcgatctgaacccggataacagcgatgtggataaactgtttattcagctggtgcagacctataaccagctgtttgaagaaaacccgattaacgcgagcggcgtggatgcgaaagcgattctgagcgcgcgcctgagcaaaagccgccgcctggaaaacctgattgcgcagctgccgggcgaaaaaaaaaacggcctgtttggcaacctgattgcgctgagcctgggcctgaccccgaactttaaaagcaactttgatctggcggaagatgcgaaactgcagctgagcaaagatacctatgatgatgatctggataacctgctggcgcagattggcgatcagtatgcggatctgtttctggcggcgaaaaacctgagcgatgcgattctgctgagcgatattctgcgcgtgaacaccgaaattaccaaagcgccgctgagcgcgagcatgattaaacgctatgatgaacatcatcaggatctgaccctgctgaaagcgctggtgcgccagcagctgccggaaaaatataaagaaattttttttgatcagagcaaaaacggctatgcgggctatattgatggcggcgcgagccaggaagaattttataaatttattaaaccgattctggaaaaaatggatggcaccgaagaactgctggtgaaactgaaccgcgaagatctgctgcgcaaacagcgcacctttgataacggcagcattccgcatcagattcatctgggcgaactgcatgcgattctgcgccgccaggaagatttttatccgtttctgaaagataaccgcgaaaaaattgaaaaaattctgacctttcgcattccgtattatgtgggcccgctggcgcgcggcaacagccgctttgcgtggatgacccgcaaaagcgaagaaaccattaccccgtggaactttgaagaagtggtggataaaggcgcgagcgcgcagagctttattgaacgcatgaccaactttgataaaaacctgccgaacgaaaaagtgctgccgaaacatagcctgctgtatgaatattttaccgtgtataacgaactgaccaaagtgaaatatgtgaccgaaggcatgcgcaaaccggcgtttctgagcggcgaacagaaaaaagcgattgtggatctgctgtttaaaaccaaccgcaaagtgaccgtgaaacagctgaaagaagattattttaaaaaaattgaatgctttgatagcgtggaaattagcggcgtggaagatcgctttaacgcgagcctgggcacctatcatgatctgctgaaaattattaaagataaagattttctggataacgaagaaaacgaagatattctggaagatattgtgctgaccctgaccctgtttgaagatcgcgaaatgattgaagaacgcctgaaaacctatgcgcatctgtttgatgataaagtgatgaaacagctgaaacgccgccgctataccggctggggccgcctgagccgcaaactgattaacggcattcgcgataaacagagcggcaaaaccattctggattttctgaaaagcgatggctttgcgaaccgcaactttatgcagctgattcatgatgatagcctgacctttaaagaagatattcagaaagcgcaggtgagcggccagggcgatagcctgcatgaacatattgcgaacctggcgggcagcccggcgattaaaaaaggcattctgcagaccgtgaaagtggtggatgaactggtgaaagtgatgggccgccataaaccggaaaacattgtgattgaaatggcgcgcgaaaaccagaccacccagaaaggccagaaaaacagccgcgaacgcatgaaacgcattgaagaaggcattaaagaactgggcagccagattctgaaagaacatccggtggaaaacacccagctgcagaacgaaaaactgtatctgtattatctgcagaacggccgcgatatgtatgtggatcaggaactggatattaaccgcctgagcgattatgatgtggatcatattgtgccgcagagctttctgaaagatgatagcattgataacaaagtgctgacccgcagcgataaaaaccgcggcaaaagcgataacgtgccgagcgaagaagtggtgaaaaaaatgaaaaactattggcgccagctgctgaacgcgaaactgattacccagcgcaaatttgataacctgaccaaagcggaacgcggcggcctgagcgaactggataaagcgggctttattaaacgccagctggtggaaacccgccagattaccaaacatgtggcgcagattctggatagccgcatgaacaccaaatatgatgaaaacgataaactgattcgcgaagtgaaagtgattaccctgaaaagcaaactggtgagcgattttcgcaaagattttcagttttataaagtgcgcgaaattaacaactatcatcatgcgcatgatgcgtatctgaacgcggtggtgggcaccgcgctgattaaaaaatatccgaaactggaaagcgaatttgtgtatggcgattataaagtgtatgatgtgcgcaaaatgattgcgaaaagcgaacaggaaattggcaaagcgaccgcgaaatattttttttatagcaacattatgaacttttttaaaaccgaaattaccctggcgaacggcgaaattcgcaaacgcccgctgattgaaaccaacggcgaaaccggcgaaattgtgtgggataaaggccgcgattttgcgaccgtgcgcaaagtgctgagcatgccgcaggtgaacattgtgaaaaaaaccgaagtgcagaccggcggctttagcaaagaaagcattctgccgaaacgcaacagcgataaactgattgcgcgcaaaaaagattgggatccgaaaaaatatggcggctttgatagcccgaccgtggcgtatagcgtgctggtggtggcgaaagtggaaaaaggcaaaagcaaaaaactgaaaagcgtgaaagaactgctgggcattaccattatggaacgcagcagctttgaaaaaaacccgattgattttctggaagcgaaaggctataaagaagtgaaaaaagatctgattattaaactgccgaaatatagcctgtttgaactggaaaacggccgcaaacgcatgctggcgagcgcgggcgaactgcagaaaggcaacgaactggcgctgccgagcaaatatgtgaactttctgtatctggcgagccattatgaaaaactgaaaggcagcccggaagataacgaacagaaacagctgtttgtggaacagcataaacattatctggatgaaattattgaacagattagcgaatttagcaaacgcgtgattctggcggatgcgaacctggataaagtgctgagcgcgtataacaaacatcgcgataaaccgattcgcgaacaggcggaaaacattattcatctgtttaccctgaccaacctgggcgcgccggcggcgtttaaatattttgataccaccattgatcgcaaacgctataccagcaccaaagaagtgctggatgcgaccctgattcatcagagcattaccggcctgtatgaaacccgcattgatctgagccagctgggcggcgat

SEQ ID NO: 30 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 31 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 33 - protein, 1404 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 34 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 35 - protein, 1368 aa, Streptococcus pyogenes [sequence omitted]

SEQ ID NO: 36 - protein, 1378 aa, Lactobacillus fermentum
MKEYHIGLDIGTSSIGWAVTDSQFKLMRIKGKTAIGVRLFEEGKTAAERRTFRTTRRRLKRRKWRLHYLDEIFAPHLQEVDENFLRRLKQSNIHPEDPTKNQAFIGKLLFPDLLKKNERGYPTLIKMRDELPVEQRAHYPVMNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKASDVASLVMAKTRGVNKPSVEGLSDPKKFNSNLATYLDLKSIVGDKVDDNRYQTDLENIIEWRSVFEDGEIFADKLTEVEWLTDEQRSALVKKRYKGWGRLSKKLLTGIVDENGQRIIDLMWNTDQNFKEIVDQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDNSLDNRVLTSRKENNKKSDQVPAKLYAAKMKPYWNQLLKQGLITQRKFENLTKDVDQNIKYRSLGFVKRQLVETRQVIKLTANILGSMYQEAGTEIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRLVDLYGAYTNGTSAFMTIIKFTGNKPKYKVIGIPTTSAASLKRAGKPGSESYNQELHRIIKSNPKVKKGFEIVVPHVSYGQLIVDGDCKFTLASPTVQHPATQLVLSKKSLETISSGYKILKDKPAIANERLIRVFDEVVGQMNRYFTIFDQRSNRQKVADARDKFLSLPTESKYEGAKKVQVGKTEVITNLLMGLHANATQGDLKVLGLATFGFFQSTTGLSLSEDTMIVYQSPTGLFERRICLKDI

SEQ ID NO: 37 - protein, 1368 aa, Streptococcus pyogenes [sequence omitted]

SEQ ID NO: 38 - protein, 1053 aa, Staphylococcus aureus
MGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKK

SEQ ID NO: 39 - protein, 1409 aa, Streptococcus thermophilus
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 40 - protein, 1402 aa, Lactobacillus crispatus
MKIKNYNLALTPSTSAVGHVEVDDDLNILEPVHHQKAIGVAKFGEGETAEARRLARSARRTTKRRANRINHYFNEIMKPEIDKVDPLMFDRIKQAGLSPLDERKEFRTVIFDRPNIASYYHNQFPTIWHLQKYLMITDEKADIRLIYWALHSLLKHRGHFFNTTPMSQFKPGKLNLKDDMLALDDYNDLEGLSFAVANSPEIEKVIKDRSMHKKEKIAELKKLIVNDVPDKDLAKRNNKIITQIVNAIMGNSFHLNFIFDMDLDKLTSKAWSFKLDDPELDTKFDAISGSMTDNQIGIFETLQKIYSAISLLDILNGSSNVVDAKNALYDKHKRDLNLYFKFLNTLPDEIAKTLKAGYTLYIGNRKKDLLAARKLLKVNVAKNFSQDDFYKLINKELKSIDKQGLQTRFSEKVGELVAQNNFLPVQRSSDNVFIPYQLNAITFNKILENQGKYYDFLVKPNPAKKDRKNAPYELSQLMQFTIPYYVGPLVTPEEQVKSGIPKTSRFAWMVRKDNGAITPWNFYDKVDIEATADKFIKRSIAKDSYLLSELVLPKHSLLYEKYEVFNELSNVSLDGKKLSGGVKQILFNEVFKKTNKVNTSRILKALAKHNIPGSKITGLSNPEEFTSSLQTYNAWKKYFPNQIDNFAYQQDLEKMIEWSTVFEDHKILAKKLDEIEWLDDDQKKFVANTRLRGWGRLSKRLLTGLKDNYGKSIMQRLETTKANFQQIVYKPEFREQIDKISQAAAKNQSLEDILANSYTSPSNRKAIRKTMSVVDEYIKLNHGKEPDKIFLMFQRSEQEKGKQTEARSKQLNRILSQLKADKSANKLFSKQLADEFSNAIKKSKYKLNDKQYFYFQQLGRDALTGEVIDYDELYKYTVLHIIPRSKLTDDSQNNKVLTKYKIVDGSVALKFGNSYSDALGMPIKAFWTELNRLKLIPKGKLLNLTTDFSTLNKYQRDGYIARQLVETQQIVKLLATIMQSRFKHTKIIEVRNSQVANIRYQFDYFRIKNLNEYYRGFDAYLAAVVGTYLYKVYPKARRLFVYGQYLKPKKTNQENQDMHLDSEKKSQGFNFLWNLLYGKQDQIFVNGTDVIAFNRKDLITKMNTVYNYKSQKISLAIDYHNGAMFKATLFPRNDRDTAKTRKLIPKKKDYDTDIYGGYTSNVDGYMLLAEIIKRDGNKQYGFYGVPSRLVSELDTLKKTRYTEYEEKLKEIIKPELGVDLKKIKKIKILKNKVPFNQVIIDKGSKFFITSTSYRWNYRQLILSAESQQTLMDLVVDPDFSNHKARKDARKNADERLIKVYEEILYQVKNYMPMFVELHRCYEKLVDAQKTFKSLKISDKAMVLNQILILLHSNATSPVLEKLGYHTRFTLGKKHNLISENAVLVTQSITGLKENHVSIKQML

SEQ ID NO: 41 - protein, 1385 aa, Pedicoccus damnosus
MTNEKYSIGLDIGTSSIGFAVVNDNNRVIRVKGKNAIGVRLFDEGKAAADRRSFRTTRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLFLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQESKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 42 - protein, 1367 aa, Fusobaterium nucleatum
MKKQKFSDYYLGFDIGTNSVGWCVTDLDYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKIIDKNNIEKLEKIVCDSKKGLKDKEKEFKEIFNSDKQLVAIFKLSVGSSVSLNDLFDTDEYKKGEVEKEKISFREQIYEDDKPIYYSILGEKIELLDIAKTFYDFMVLNNILADSQYISEAKVKLYEEHKKDLKNLKYIIRKYNKGNYDKLFKDKNENNYSAYIGLNKEKSKKEVIEKSRLKIDDLIKNIKGYLPKVEEIEEKDKAIFNKILNKIELKTILPKQRISDNGTLPYQIHEAELEKILENQSKYYDFLNYEENGIITKDKLLMTFKFRIPYYVGPLNSYHKDKGGNSWIVRKEEGKILPWNFEQKVDIEKSAEEFIKRMTNKCTYLNGEDVIPKDTFLYSEYVILNELNKVQVNDEFLNEENKRKIIDELFKENKKVSEKKFKEYLLVKQIVDGTIELKGVKDSFNSNYISYIRFKDIFGEKLNLDIYKEISEKSILWKCLYGDDKKIFEKKIKNEYGDILTKDEIKKINTFKFNNWGRLSEKLLTGIEFINLETGECYSSVMDALRRTNYNLMELLSSKFTLQESINNENKEMNEASYRDLIEESYVSPSLKRAIFQTLKIYEEIRKITGRVPKKVFIEMARGGDESMKNKKIPARQEQLKKLYDSCGNDIANFSIDIKEMKNSLISYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEKKGQLFDLNPIKKGETSNEIISIKPKVYNGKDDKLNEKYGYYKSLNPAYFLYVEHKEKNKRIKSFERVNLVDVNNIKDEKSLVKYLIENKKLVEPRVIKKVYKRQVILINDYPYSIVTLDSNKLMDFENLKPLFLENKYEKILKNVIKFLEDNQGKSEENYKFIYLKKKDRYEKNETLESVKDRYNLEFNEMYDKFLEKLDSKDYKNYMNNKKYQELLDVKEKFIKLNLFDKAFTLKSFLDLFNRKTMADFSKVGLTKYLGKIQKISSNVLSKNELYLLEESVTGLFVKKIKL

SEQ ID NO: 43 - protein, 1346 aa, Enterococcus cecorum
MNKYYLGLDMGSASVGWAVTDENYHLVRRKGKDLWGVRTFDVAQTAKERRITRGNRRRQDRRKQRIQILQELLGEEVLKTDPGFFHRMKESRYVVEDKRTLDGKQVELPYALFVDKDYTDKEYYKQFPTINHLIVYLMTTSDTPDIRLVYLALHYYMKNRGNFLHSGDINNVKDINDILEQLDNVLETFLDGWNLKLKSYVEDIKNIYNRDLGRGERKKAFVNTLGAKTKAEKAFCSLISGGSTNLAELFDDSSLKEIETPKIEFASSSLEDKIDGIQEALEDRFAVIEAAKRLYDWKTLTDILGDSSSLAEARVNSYQMHHEQLLELKSLVKEYLDRKVFQEVFVSLNVANNYPAYIGHTKINGKKKELEVKRTKRNDFYSYVKKQVIEPIKKKVSDEAVLTKLSEIESLIEVDKYLPLQVNSDNGVIPYQVKLNELTRIFDNLENRIPVLRENRDKIIKTFKFRIPYYVGSLNGVVKNGKCTNWMVRKEEGKIYPWNFEDKVDLEASAEQFIRRMTNKCTYLVNEDVLPKYSLLYSKYLVLSELNNLRIDGRPLDVKIKQDIYENVFKKNRKVTLKKIKKYLLKEGIITDDDELSGLADDVKSSLTAYRDFKEKLGHLDLSEAQMENIILNITLFGDDKKLLKKRLAALYPFIDDKSLNRIATLNYRDWGRLSERFLSGITSVDQETGELRTIIQCMYETQANLMQLLAEPYHFVEAIEKENPKVDLESISYRIVNDLYVSPAVKRQIWQTLLVIKDIKQVMKHDPERIFIEMAREKQESKKTKSRKQVLSEVYKKAKEYEHLFEKLNSLTEEQLRSKKIYLYFTQLGKCMYSGEPIDFENLVSANSNYDIDHIYPQSKTIDDSFNNIVLVKKSLNAYKSNHYPIDKNIRDNEKVKTLWNTLVSKGLITKEKYERLIRSTPFSDEELAGFIARQLVETRQSTKAVAEILSNWFPESEIVYSKAKNVSNFRQDFEILKVRELNDCHHAHDAYLNIVVGNAYHTKFTNSPYRFIKNKANQEYNLRKLLQKVNKIESNGVVAWVGQSENNPGTIATVKKVIRRNTVLISRMVKEVDGQLFDLTLMKKGKGQVPIKSSDERLTDISKYGGYNKATGAYFTFVKSKKRGKVVRSFEYVPLHLSKQFENNNELLKEYIEKDRGLTDVEILIPKVLINSLFRYNGSLVRITGRGDTRLLLVHEQPLYVSNSFVQQLKSVSSYKLKKSENDNAKLTKTATEKLSNIDELYDGLLRKLDLPIYSYWFSSIKEYLVESRTKYIKLSIEEKALVIFEILHLFQSDAQVPNLKILGLSTKPSRIRIQKNLKDTDKMSIIHQSPSGIFEHEIELTSL

SEQ ID NO: 44 - protein, 1312 aa, Anaerostipes hadrus
MQNGFLGITVSSEQVGWAVTNPKYELERASRKDLWGVRLFDKAETAEDRRMFRTNRRLNQRKKNRIHYLRDIFHEEVNQKDPNFFQQLDESNFCEDDRTVEFNFDTNLYKNQFPTVYHLRKYLMETKDKPDIRLVYLAFSKFMKNRGHFLYKGNLGEVMDFENSMKGFCESLEKFNIDFPTLSDEQVKEVRDILCDHKIAKTVKKKNIITITKVKSKTAKAWIGLFCGCSVPVKVLFQDIDEEIVTDPEKISFEDASYDDYIANIEKGVGIYYEAIVSAKMLFDWSILNEILGDHQLLSDAMIAEYNKHHDDLKRLQKIIKGTGSRELYQDIFINDVSGNYVCYVGHAKTMSSADQKQFYTFLKNRLKNVNGISSEDAEWIDTEIKNGTLLPKQTKRDNSVIPHQLQLREFELILDNMQEMYPFLKENREKLLKIFNFVIPYYVGPLKGVVRKGESTNWMVPKKDGVIHPWNFDEMVDKEASAECFISRMTGNCSYLFNEKVLPKNSLLYETFEVLNELNPLKINGEPISVELKQRIYEQLFLTGKKVTKKSLTKYLIKNGYDKDIELSGIDNEFHSNLKSHIDFEDYDNLSDEEVEQIILRITVFEDKQLLKDYLNREFVKLSEDERKQICSLSYKGWGNLSEMLLNGITVTDSNGVEVSVMDMLWNTNLNLMQILSKKYGYKAEIEHYNKEHEKTIYNREDLMDYLNIPPAQRRKVNQLITIVKSLKKTYGVPNKIFFKISREHQDDPKRTSSRKEQLKYLYKSLKSEDEKHLMKELDELNDHELSNDKVYLYFLQKGRCIYSGKKLNLSRLRKSNYQNDIDYIYPLSAVNDRSMNNKVLTGIQENRADKYTYFPVDSEIQKKMKGFWMELVLQGFMTKEKYFRLSRENDFSKSELVSFIEREISDNQQSGRMIASVLQYYFPESKIVFVKEKLISSFKRDFHLISSYGHNHLQAAKDAYITIVVGNVYHTKFTMDPAIYFKNHKRKDYDLNRLFLENISRDGQIAWESGPYGSIQTVRKEYAQNHIAVTKRVVEVKGGLFKQMPLKKGHGEYPLKTNDPRFGNIAQYGGYTNVTGSYFVLVESMEKGKKRISLEYVPVYLHERLEDDPGHKLLKEYLVDHRKLNHPKILLAKVRKNSLLKIDGFYYRLNGRSGNALILTNAVELIMDDWQTKTANKISGYMKRRAIDKKARVYQNEFHIQELEQLYDFYLDKLKNGVYKNRKNNQAELIHNEKEQFMELKTEDQCVLLTEIKKLFVCSPMQADLTLIGGSKHTGMIAMSSNVTKADFAVIAEDPLGLRNKVIYSHKGEK

SEQ ID NO: 45 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 46 - protein, 1288 aa, Enterococcus faecalis
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 47 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 48 - protein, 1082 aa, Geobacillus thermodenitrificans
MKYKIGLDIGITSIGWAVINLDIPRIEDLGVRIFDRAENPKTGESLALPRRLARSARRRLRRRKHRLERIRRLFVREGILTKEELNKLFEKKHEIDVWQLRVEALDRKLNNDELARILLHLAKRRGFRSNRKSERTNKENSTMLKHIEENQSILSSYRTVAEMVVKDPKFSLHKRNKEDNYTNTVARDDLEREIKLIFAKQREYGNIVCTEAFEHEYISIWASQRPFASKDDIEKKVGFCTFEPKEKRAPKATYTFQSFTVWEHINKLRLVSPGGIRALTDDERRLIYKQAFHKNKITFHDVRTLLNLPDDTRFKGLLYDRNTTLKENEKVRFLELGAYHKIRKAIDSVYGKGAAKSFRPIDFDTFGYALTMFKDDTDIRSYLRNEYEQNGKRMENLADKVYDEELIEELLNLSFSKFGHLSLKALRNILPYMEQGEVYSTACERAGYTFTGPKKKQKTVLLPNIPPIANPVVMRALTQARKVVNAIIKKYGSPVSIHIELARELSQSFDERRKMQKEQEGNRKKNETAIRQLVEYGLTLNPTGLDIVKFKLWSEQNGKCAYSLQPIEIERLLEPGYTEVDHVIPYSRSLDDSYTNKVLVLTKENREKGNRTPAEYLGLGSERWQQFETFVLTNKQFSKKKRDRLLRLHYDENEENEFKNRNLNDTRYISRFLANFIREHLKFADSDDKQKVYTVNGRITAHLRSRWNFNKNREESNLHHAVDAAIVACTTPSDIARVTAFYQRREQNKELSKKTDPQFPQPWPHFADELQARLSKNPKESIKALNLGNYDNEKLESLQPVFVSRMPKRSITGAAHQETLRRYIGIDERSGKIQTVVKKKLSEIQLDKTGHFPMYGKESDPRTYEAIRQRLLEHNNDPKKAFQEPLYKPKKNGELGPIIRTIKIIDTTNQVIPLNDGKTVAYNSNIVRVDVFEKDGKYYCVPIYTIDMMKGILPNKAIEPNKPYSEWKEMTEDYTFRFSLYPNDLIRIEFPREKTIKTAVGEEIKIKDLFAYYQTIDSSNGGLSLVSHDNNFSLRSIGSRTLKRFEKYQVDVLGNIYKVRGEKRVGVASSSHSKAGETIRPL

SEQ ID NO: 49 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 50 - protein, 1368 aa, Streptococcus pyogenes
  misc_feature (10)..(10): Xaa can be any naturally occurring amino acid
  misc_feature (840)..(840): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 52 - protein, 1368 aa, Streptococcus pyogenes
  misc_feature (10)..(10): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 53 - protein, 1368 aa, Streptococcus pyogenes
  misc_feature (762)..(762): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIXMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1368 aa, Streptococcus pyogenes
  misc_feature (983)..(983): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHXAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 55 - protein, 1368 aa, Streptococcus pyogenes
  misc_feature (986)..(986): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHXAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 56 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 57 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIAMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 58 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHAAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 59 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHAAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 60 - protein, 1368 aa, Streptococcus pyogenes
  misc_feature (840)..(840): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 61 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 62 - protein, 1368 aa, Streptococcus pyogenes
  misc_feature (864)..(864): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 63 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 64 - protein, 1367 aa, Streptococcus pyogenes
  misc_feature (839)..(839): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 65 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 66 - protein, 1367 aa, Streptococcus pyogenes
  misc_feature (863)..(863): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 67 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 68 - protein, 1053 aa, Staphylococcus aureus; identical to SEQ ID NO: 38

SEQ ID NO: 69 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDAALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 70 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 71 - protein, 1087 aa, Geobacillus stearothermophilus
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 72 - protein, 1228 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 73 - protein, 1108 aa, Bacillus hisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 74 - protein, 1307 aa, Acidaminococcus sp
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 75 - protein, 1307 aa, Artificial Sequence
  Synthetic
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMANSNAATGEDYINSPVRDLNGVCFDSRFQNPEWPMDADANGAYHIALKGQLLLNHLKESKDLKLQNGISNQDWLAYIQELRN

SEQ ID NO: 76 - protein, 1259 aa, Unknown
  Lachnospiraceae bacterium
MNYKTGLEDFIGKESLSKTLRNALIPTESTKIHMEEMGVIRDDELRAEKQQELKEIMDDYYRTFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDVAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTILASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 77 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 78 - protein, 1142 aa, Eubacterium rectale
MFSAKLISDILPEFVIHNNNYSASEKEEKTQVIKLFSRFATSFKDYFKNRANCFSANDISSSSCHRIVNDNAEIFFSNALVYRRIVKNLSNDDINKISGDMKDSLKEMSLEEIYSYEKYGEFITQEGISFYNDICGKVNLFMNLYCQKNKENKNLYKLRKLHKQILCIADTSYEVPYKFESDEEVYQSVNGFLDNISSKHIVERLRKIGENYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSTYEDISGFYREVELQGYKIDWTYISEKDIDLLQEKGQLYLFQIYNKDFSKKSSGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 79 - protein, 1259 aa, Unknown
  Clostridium sp. AF34-10BH
MNYKTGLEDFIGKESLSKTLRNALIPTESTKIHMEEMGVIRDDELRAEKQQELKEIMDDYYRAFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYLVDFYDRVLTQPGIEYYNGICGKINEHMNQFCQKNRINKNDFRMKKLHKQILCKKSSYYEIPFRFESDQEVYDALNEFIKTMKEKEIICRCVHLGQKCDDYDLGKIYISSNKYEQISNALYGSWDTIRKCIKEEYMDALPGKGEKKEEKAEAAAKKEEYRSIADIDKIISLYGSEMDRTISAKKCITEICDMAGQISTDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPVVHKKGSVLVNRSYTQTVGDKEIRVSIPEEYYTEIYNYLNHIGRGKLSTEAQRYLEERKIKSFTATKDIVKNYRYCCDHYFLHLPITINFKAKSDIAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTMLASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 80 - protein, 1108 aa, Bacillus hisashii; identical to SEQ ID NO: 73

SEQ ID NO: 81 - protein, 1465 aa, Thermomonas hydrothermalis
MSEKTTQRAYTLRLNRASGECAVCQNNSCDCWHDALWATHKAVNRGAKAFGDWLLTLRGGLCHTLVEMEVPAKGNNPPQRPTDQERRDRRVLLALSWLSVEDEHGAPKEFIVATGRDSADDRAKKVEEKLREILEKRDFQEHEIDAWLQDCGPSLKAHIREDAVWVNRRALFDAAVERIKTLTWEEAWDFLEPFFGTQYFAGIGDGKDKDDAEGPARQGEKAKDLVQKAGQWLSARFGIGTGADFMSMAEAYEKIAKWASQAQNGDNGKATIEKLACALRPSEPPTLDTVLKCISGPGHKSATREYLKTLDKKSTVTQEDLNQLRKLADEDARNCRKKVGKKGKKPWADEVLKDVENSCELTYLQDNSPARHREFSVMLDHAARRVSMAHSWIKKAEQRRRQFESDAQKLKNLQERAPSAVEWLDRFCESRSMTTGANTGSGYRIRKRAIEGWSYVVQAWAEASCDTEDKRIAAARKVQADPEIEKFGDIQLFEALAADEAICVWRDQEGTQNPSILIDYVTGKTAEHNQKRFKVPAYRHPDELRHPVFCDFGNSRWSIQFAIHKEIRDRDKGAKQDTRQLQNRHGLKMRLWNGRSMTDVNLHWSSKRLTADLALDQNPNPNPTEVTRADRLGRAASSAFDHVKIKNVFNEKEWNGRLQAPRAELDRIAKLEEQGKTEQAEKLRKRLRWYVSFSPCLSPSGPFIVYAGQHNIQPKRSGQYAPHAQANKGRARLAQLILSRLPDLRILSVDLGHRFAAACAVWETLSSDAFRREIQGLNVLAGGSGEGDLFLHVEMTGDDGKRRTVVYRRIGPDQLLDNTPHPAPWARLDRQFLIKLQGEDEGVREASNEELWTVHKLEVEVGRTVPLIDRMVRSGFGKTEKQKERLKKLRELGWISAMPNEPSAETDEKEGEIRSISRSVDELMSSALGTLRLALKRHGNRARIAFAMTADYKPMPGGQKYYFHEAKEASKNDDETKRRDNQIEFLQDALSLWHDLFSSPDWEDNEAKKLWQNHIATLPNYQTPEEISAELKRVERNKKRKENRDKLRTAAKALAENDQLRQHLHDTWKERWESDDQQWKERLRSLKDWIFPRGKAEDNPSIRHVGGLSITRINTISGLYQILKAFKMRPEPDDLRKNIPQKGDDELENFNRRLLEARDRLREQRVKQLASRIIEAALGVGRIKIPKNGKLPKRPRTTVDTPCHAVVIESLKTYRPDDLRTRRENRQLMQWSSAKVRKYLKEGCELYGLHFLEVPANYTSRQCSRTGLPGIRCDDVPTGDFLKAPWWRRAINTAREKNGGDAKDRFLVDLYDHLNNLQSKGEALPATVRVPRQGGNLFIAGAQLDDTNKERRAIQADLNAAANIGLRALLDPDWRGRWWYVPCKDGTSEPALDRIEGSTAFNDVRSLPTGDNSSRRAPREIENLWRDPSGDSLESGTWSPTRAYWDTVQSRVIELLRRHAGLPTS

SEQ ID NO: 82 - protein, 1090 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 83 - protein, 1194 aa, Dsulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 84 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 85 - protein, 1082 aa, Geobacillus thermodenitrificans; identical to SEQ ID NO: 48

SEQ ID NO: 86 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 87 - protein, 1387 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYG

SEQ ID NO: 88 - protein, 1388 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQ

SEQ ID NO: 89 - protein, 1387 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYS

SEQ ID NO: 90 - protein, 1388 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGS

SEQ ID NO: 91 - protein, 1387 aa, Artificial Sequence
  Synthetic
KPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRD

SEQ ID NO: 92 - protein, 357 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 93 - protein, 341 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 94 - protein, 328 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 95 - protein, 120 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 96 - protein, 69 aa, Artificial Sequence
  Synthetic
KPIREQAENIIHLFTLTNLGAPAAFKYFDTTIDRKRYTSTKEVLDATLIHQSITGLYETRIDLSQLGGD

SEQ ID NO: 97 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 98 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 99 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 100 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 101 - protein, 16 aa, Artificial Sequence
  Synthetic
SGSETPGTSESATPES

SEQ ID NO: 102 - protein, 32 aa, Artificial Sequence
  Synthetic
SGGSSGGSSGSETPGTSESATPESSGGSSGGS

SEQ ID NO: 103 - protein, 16 aa, Artificial Sequence
  Synthetic
SGSETPGTSESATPES

SEQ ID NO: 104 - protein, 4 aa, Artificial Sequence
  Synthetic
  REPEAT (1)..(4)
SGGS

SEQ ID NO: 105 - protein, 4 aa, Artificial Sequence
  Synthetic
  REPEAT (1)..(4)
GGGS

SEQ ID NO: 106 - protein, 5 aa, Artificial Sequence
  Synthetic
  REPEAT (1)..(5)
GGGGS

SEQ ID NO: 107 - protein, 1 aa, Artificial Sequence
  Synthetic
  REPEAT (1)..(1)
G

SEQ ID NO: 108 - protein, 5 aa, Artificial Sequence
  Synthetic
  REPEAT (1)..(5)
EAAAK

SEQ ID NO: 109 - protein, 24 aa, Artificial Sequence
  Synthetic
  REPEAT (1)..(4)
  REPEAT (21)..(24)
SGGSSGSETPGTSESATPESSGGS

SEQ ID NO: 110 - protein, 3 aa, Artificial Sequence
  Synthetic
  REPEAT (1)..(3)
GGS

SEQ ID NO: 111 - protein, 2 aa, Artificial Sequence
  Synthetic
  REPEAT (1)..(2)
  MISC_FEATURE (1)..(1): Xaa can be any naturally occurring amino acid
XP

SEQ ID NO: 112 - protein, 32 aa, Artificial Sequence; identical to SEQ ID NO: 102
  Synthetic

SEQ ID NO: 113 - protein, 104 aa, Artificial Sequence
  Synthetic
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 114 - protein, 24 aa, Artificial Sequence
  Synthetic
SGGSSGGSSGSETPGTSESATPES

SEQ ID NO: 115 - protein, 40 aa, Artificial Sequence
  Synthetic
SGGSSGGSSGSETPGTSESATPESSGGSSGGSSGGSSGGS

SEQ ID NO: 116 - protein, 64 aa, Artificial Sequence
  Synthetic
SGGSSGGSSGSETPGTSESATPESSGGSSGGSSGGSSGGSSGSETPGTSESATPESSGGSSGGS

SEQ ID NO: 117 - protein, 92 aa, Artificial Sequence
  Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 118 - protein, 84 aa, Artificial Sequence; identical to SEQ ID NO: 27
  Synthetic

SEQ ID NO: 119 - protein, 7 aa, Artificial Sequence
  Synthetic
PKKKRKV

SEQ ID NO: 120 - protein, 8 aa, Artificial Sequence
  Synthetic
VSRKRPRP

SEQ ID NO: 121 - protein, 9 aa, Artificial Sequence
  Synthetic
PAAKRVKLD

SEQ ID NO: 122 - protein, 9 aa, Artificial Sequence
  Synthetic
KLKIKRPVK

SEQ ID NO: 123 - protein, 10 aa, Artificial Sequence
  Synthetic
EGAPPAKRAR

SEQ ID NO: 124 - protein, 12 aa, Artificial Sequence
  Synthetic
PPQPKKKPLDGE

SEQ ID NO: 125 - protein, 19 aa, Artificial Sequence
  Synthetic
MKRTADGSEFESPKKKRKV

SEQ ID NO: 126 - protein, 20 aa, Artificial Sequence
  Synthetic
AVKRPAATKKAGQAKKKKLD

SEQ ID NO: 127 - protein, 21 aa, Artificial Sequence
  Synthetic
SGGSKRTADGSEFEPKKKRKV

SEQ ID NO: 128 - protein, 25 aa, Artificial Sequence
  Synthetic
MSRRRKANPTKLSENAKKLAKEVEN

SEQ ID NO: 129 - protein, 30 aa, Artificial Sequence
  Synthetic
MDSLLMNRRKFLYQFKNVRWAKGRRETYLC

SEQ ID NO: 130 - protein, 1425 aa, Burkholderia gladioli
MYEAARVTDPIEHTSALAGFLVGAVLGIALIAAVAFATFTCGFGVALLAGMAAGIGAQVLLSLGESIGKMFSSQSGAITLGSPNVYVNGKQAAYATLSSVTCSKHNPTPLVAQGSTNIFINGKPAARKDDKITCGAAISDGSHDTYFHGGIQTCLPIDDEVPPWLRTATDWAFALAGLVGGLGGLLKEAGGLSHAVMPCAAKFIGGYVLGEAASRYVIGPAINSAIGGMFGNPVDVTTGRKILPAESETDYVVPSPMPVAIRRFYSSDLDYVGTLGRGWVLPWELRLHARDGRLWYTDAQGRESGFPILKPGQAAFSEADQRYLTCTPDGRYILHDVGETYYDFGRYEPGSGRIGWVRRIEDQAGQWCQFERDSRGRVREIQTCGGLLAVLDYEPEHERLAEVSLVSGDQRRLVVAYGYDENGQMASVTDANGAVVRRFTYADGRMTSHSNALGFTSGYTWKVIDGTPRVVATHTSEGEAWAFEYDIEGRRTHVRHADGRHAQWRYDAQFQIVEYLDFDGRRYGLKYNAAGMPVMLTLPGERTVMFEYDDAGRIVAETDPLGRTTKTRYDGNSMRPVEIILPDGSAWHAEYDRQGRLLVTRDPLDRENRYEYPEALSALPVAHVDALGGRKTFEWNRLGELVAYTDCSGKTTRNFFDAFGLPLARENALGHRVSFDLRPTGETRRVTYPDGSSESYEYDAAGLMIRHIGLGGRMQTLQRNARGQLVEAVDPAGRRTRYHYDAEGRLRELQQAHARYAFAYSAGGRLVSETRPDGVLRRFEYGEAGDLAALEIVGTADDCAPNDRPVRAIRFERDRMGNLCVQHTPTEVTRYERDAGGRLLEVASVPTAAGLALGIAPDTLTFEYDKAGRLSAEHGANGSVQYTLDALDNVLKLALPHEQTLQMLRYGSGHVHQIRHGDQVVSDFERDDLHRELTRTQGPLTERTAYDLLGRKIWQSAGFQPDALARGQGQLWRNYGYDAAGELVESHDSLRGSTQFSYDPAGYLTQRVNTADRQLESFAWDAAGNLLDDAQRSSRGYVEGNRLRMWQNLRFDYDAFGNLATKLRGANQRQQFTYDGQDRLVAVRTQGARGVVETRFAYDPLGRRIAKTDRTLDVRGVTLREETKRFVWEGLRLAQEVRDTGVSSYVYSPDAPYMPAARVDAVKAEALANAAIDKARQATRIYHFHTDVSGAPQEATNEAGDIVWAGQYSAWGKVAPNQHAPARIDQPLRYAGQYADDSTELHYNTFRFYDPDVGRFINQDPIGLMGGLNLYQYAPNSIAWTDWWGLAGSYTLGSYQISAPQLPAYNGQTVGTFYYVNDAGGLESRTFSSGGPTPYPNYANAGHVEGQSALFMRDNGISDGLVFHNNPEGTCGFCVNMTETLLPENSKLTVVPPEGSIPVKRGATGETRTFTGNSKSPKSPVKGGC

SEQ ID NO: 131 - DNA, 4278 bp, Burkholderia gladioli
gtgtacgaagcggcccgcgtcacggatccgatcgagcacaccagcgcgctggccggcttcctggtgggcgccgtgctcggtatcgccctgattgctgccgtggcgttcgccacgttcacctgcggcttcggcgtggcactgctggccggcatggcggccggcatcggcgcgcaggtgctgttgtcgttaggggaatcgatcgggaagatgttcagttcgcaatccggcgcgatcacgctcggctcgccgaacgtctacgtgaacggcaagcaggccgcctacgccacgctcagcagcgtgacgtgcagcaagcacaacccgacgccgctcgtcgcgcagggctccaccaacatcttcatcaacggcaagccggccgcgcgcaaggacgacaagatcacctgcggcgcggccatctcggacggctcgcacgacacctacttccacggaggcatccagacctgcctgccgatcgacgacgaagtgccgccgtggctgcgcaccgccaccgactgggcgttcgcgctggccgggctggtgggcgggctcggcggcctactcaaggaagcgggcgggctgtcgcacgcggtgatgccgtgcgcggcgaagttcatcggcggctacgtgctcggcgaggcggcgagccgctacgtgatcggcccggccatcaacagcgcgatcggcgggatgttcggcaacccggtagacgtcaccactgggcgcaagatcctccctgccgaatcggaaaccgattacgtcgtgcccagcccgatgccggtggcgatccggcgcttctattcgagcgacctcgattacgtcggcacgcttgggcgcggctgggtgctgccgtgggagctgcgcctgcacgcgcgtgacggtcggctctggtacaccgacgcgcaggggcgcgagagcggcttcccgatcctgaaaccgggccaggccgcgttcagcgaggccgatcagcgctatctgacctgcacgccggatggccgctacatcctccacgacgtcggcgaaacctattacgacttcggccgctacgagccgggctcgggccgcatcggctgggtgcgccggatcgaggatcaggccggccagtggtgccagttcgagcgcgacagccgtggccgcgtgcgtgaaatccagacctgcggcggcttgctggccgtgctcgattacgagccggagcacgagcggctcgccgaggtgtcgctcgtcagcggcgatcagcgccgcctcgtcgtggcctacggctacgacgaaaacggccagatggcctccgtgaccgacgcgaacggcgcggtggtgcgccgcttcacctatgccgacgggcgcatgacgagccattcgaacgcgctcggtttcacgtcgggctatacgtggaaggtcatcgacggcacgccgcgagtggtcgccacccacaccagcgagggcgaggcctgggcgttcgagtacgacatcgaaggccgccgcacccatgtgcggcatgccgacggccgccacgcgcaatggcgctacgacgcgcaattccagatcgtcgagtacctcgatttcgacggccgtcgctacgggctcaagtacaacgctgccggcatgcccgtgatgctgacgctgcccggcgaacgaaccgtgatgttcgagtacgacgacgccggccgcatcgtcgccgaaaccgatcccctcggccgcaccacgaaaacgcgctacgacggcaacagcatgcggcccgtcgagatcatcttgcccgacggcagcgcctggcacgccgaatacgaccggcagggccggctgctcgtcacccgtgatccgctcgaccgggagaatcgctacgaatatccggaggcactgagcgcgctcccggtggcgcatgtcgatgcgctgggcgggcgcaagacgttcgagtggaaccggctcggcgagctggtggcctacaccgattgctcgggcaagaccacgcgcaattttttcgatgcattcggcctgccgctcgcgcgcgagaacgcgctcgggcaccgcgtgtcgttcgatctgcgcccgaccggcgagacgcgccgcgtcacctatcccgacggcagttccgaaagctacgaatacgacgccgccgggctgatgatccggcacatcgggctgggcggccggatgcagacgttgcagcgcaatgcgcgcgggcaactcgtcgaggcggtcgatccggccgggcggcgaacccgctaccactacgacgccgaagggcggctgcgcgagctgcaacaggcccacgcgcgctacgcattcgcgtacagcgcaggcgggcggcttgtcagcgaaacgcggcccgacggcgtgctgcgccgcttcgaatacggcgaggccggcgatctggcggcgctcgagatcgtcggaacggccgatgattgcgctccaaacgatcgcccggttcgcgcgatccgcttcgagcgcgaccggatgggtaacctgtgcgtgcagcacacgcctaccgaggtgacgcgctacgagcgcgacgccggcggccgcctgctcgaagtcgcgagcgtgccgaccgcggccggactggcgctcggcatcgcgcccgacacgctgaccttcgaatacgacaaggccgggcggctgagcgccgaacacggcgcgaacggcagcgtccagtacacgctcgacgcgctcgacaacgtgttgaagctcgccttgccgcacgaacagacgctgcagatgctgcgctacggctcggggcacgtgcaccagattcgccacggcgaccaggtcgtcagcgatttcgagcgcgacgacctgcatcgcgagttgacgcgcacgcagggccccctgaccgagcggaccgcctacgacctgctgggccgcaagatctggcaatcagccggcttccagcccgacgcgcttgcgcgtgggcagggccagctgtggcgcaactacggctacgacgccgccggggaactggtcgagagccacgacagcctgcgcggcagcacgcagttcagctacgatccggccggctatctgacgcagcgcgtgaacaccgccgaccggcagctcgaatcgttcgcctgggacgccgccggcaacctgctcgacgatgcgcaacgcagcagccgcggctatgtcgagggcaaccggctgcgcatgtggcagaacctgcgcttcgactacgacgcgttcggcaatctcgcgaccaagctgcgcggcgcgaatcagcgccagcagttcacgtacgatgggcaggatcggctcgtggccgtgcgcacgcagggcgcgcgcggcgtggtggagacgcgtttcgcctacgatccgctcgggcggcgcatcgccaagaccgataggacactcgacgtgcgcggcgtaacgctgcgcgaggaaacgaagcggttcgtatgggaagggctgcggctcgcgcaggaggtgcgcgacaccggcgtgagcagctacgtgtacagcccggatgcgccttacatgcccgcggcgcgggtcgatgcggtgaaagccgaagcgctcgcaaacgccgcgatcgacaaggccagacaggcgacgcggatctatcactttcataccgatgtgtcgggcgcaccgcaagaagcgacgaacgaggccggcgacattgtttgggccggccaatactcagcctggggcaaggtggcgccgaaccagcatgccccagcccggatcgatcagccgctccgctacgccggacaatatgccgatgacagtaccgagctgcactacaacacgtttcgtttctacgatccggatgtcggccggtttatcaatcaggatccaatcgggttgatgggggggctgaatctttaccaatatgcacccaactcaatcgcgtggaccgactggtgggggctggccggcagctatacgctcggttcctatcaaatttctgctcctcaacttcccgcctacaatgggcagactgttgggaccttctactatgtaaacgacgcgggcgggctcgaatcgaggacattctcttctggagggccgaccccttatccaaattatgccaatgccgggcacgtggaaggccagtccgcactgttcatgagggataacggaatttcagacggactggttttccacaacaaccctgagggtacttgcggattctgcgtcaatatgaccgaaacgcttttgcctgaaaattccaaacttaccgtcgttccgcccgagggctcgattccggtcaagcggggcgcgacgggcgaaacgagaacatttacagggaacagcaagtctccgaagtcccctgtcaaaggaggatgttga

SEQ ID NO: 132 - protein, 1425 aa, Burkholderia glumae
MYEAARVTDPIEHTSALTGFLVGAVLGIALIAAVAFATFTCGFGVALLAGMAAGIGAQVLLSLGESIGKMFSSQSGAITLGSPNVYVNGKPTAYAMLSSVTCSKHNPTPLVAQGSTNIFINGKPAARKDDKITCGATISDGSHDTYFHGGTQTCLPIDDEVPPWLRTATDWAFALAGLVGGLGGLLKEAGGLSRAVMPCAAKFIGGYVLGEAASRYVVGPAINSAIGGMFGNPVDVTTGRKILLAESETDYVVPSPMPVAIRRFYSSDLDYVGTLGRGWVLPWELRLHARDGRLWYTDAQGRESGFPMLQPGHAAFSEADQRYLTCTPDGRYILHDLGETYYDFGHYEPGSGRIGWVRRIEDQAGQWCQFERDSRGRVREIQTCGGLLAVLDYEPEHGRLAGVSLVSGDQRRLVVAYGYDEHGQMASVTDANGALVRRFTYADGRMTSHSNALGFTSGYTWQAVGGAPRVVATHTSEGEAWAFEYDIEGRRTHVRHADGRHAQWRYDAQFQIVEYLDFDGRRYGLKYNDAGMPVMLTLPGERTVTFEYDDAGRIVAETDPLGRTTKTRYDGNSRRPVEIIAPDGSAWHAEYDRQGRLLATRDPLDRENRYEYPKALSALPIAHVDALGGRKTFEWNRLGELVAYTDCSGKTTRNFYDAFGLPLARENALGHRVTFDLRPTGEARRVTYPDGSTESYEYDAAGLMIRHVGLGGRTQIALRNARGQIVEAVDPAGRRTCYRYDAEGRLRELQQGHARYAFTYSAGGRLTSETRPDGVRRRFEYGEAGDLAALDIVGAADDATANDRPVRTIRFERDRMGNLCAQHTPTEVTRYTRDTGGRLLEVACVPTAAGLALGIAPDTLTFEYDKAGRLSAEHGANGSVRYTLDALDNVMKLALPHEQTLQMLRYGSGHVHQIRCGDQVVSDFERDDLHRELTRTQGRLTERTAYDLLGRKIWQSAGFQPDALARGQGQVWRNYGYDAAGELAESHDSLRGSTQFSYDPAGYLTQRVNTADRQLESFAWDAAGNLLDDAQRRSRGYVEGNRLRMWQNLRFEYDPFGNLATKLRGANQRQQFTYDGQDRLVAVRTQDARGVVETRFAYDPLGRRIAKTDIVRDARGVALREETKRFVWEGLRLAQEVRDTGVSSYVYSPDAPYTPAARVDAVLAEAMAAAAIEQARQATRIYHFHTDVSGAPQEATNEAGDIVWAGQYSAWGKVAPNQHAPARIDQPLRYAGQYADDSTELHYNTFRFYDPDVGRFINQDPIGLMGGLNLYQYAPNSIAWTDWWGLAGSYTLGSYQISAPQLPAYNGQTVGTFYYVNGAGGLESRTFSSGGPTPYPNYANAGHVEGQSALFMRDNGISDGLVFHNNPEGTCGFCVNMTETLLPENSKLTVVPPEGAIPVKRGATGETRTFTGNSKSPKSPVKGEC

SEQ ID NO: 133 - DNA, 4278 bp, Burkholderia glumae
gtgtacgaagcggcccgcgtcaccgacccgatcgaacacaccagcgcgctgaccggctttctggtgggcgccgtgctcggcattgccctgatcgccgcggtggcgttcgccaccttcacctgcggcttcggcgtggcgctgctggccggcatggccgccggcatcggcgcgcaggtgctgttgtcgttaggagaatcgatcgggaagatgttcagttcgcaatccggcgcgatcacgctcggctcgccgaacgtctatgtgaacggcaagccgaccgcctacgccatgctcagcagcgtgacgtgcagcaagcacaacccgacgccgctcgtcgcgcaggggtccaccaacatcttcatcaacggcaagccggccgcccgcaaggacgacaagatcacctgcggcgcgaccatctccgacggctcgcacgacacctatttccacggcggcacccagacctgcctgccgatcgacgacgaagtgccgccgtggctgcgcaccgccaccgactgggcgttcgcgctggccgggctggtgggcgggctcggcggcctgctcaaggaagcgggcgggctgtcgcgcgcggtgatgccgtgcgcggcgaagttcatcggcggctacgtgctcggcgaggcggcgagccgctacgtggtcggcccggccatcaacagcgcgatcggcgggatgttcggcaacccggtggacgtcaccaccgggcgcaagatcctgctggcggaatcggaaaccgattacgtggtgcccagcccgatgccggtggcgatccggcgcttctattcgagcgacctcgactacgtcggcacgctcgggcgcggctgggtgctgccgtgggaactgcggctgcacgcgcgcgacgggcggctctggtacaccgacgcgcaggggcgcgagagcggcttcccgatgctccagccgggccatgccgcgttcagcgaggccgaccagcgctatctgacctgcaccccggatggccgctacatcctgcacgacctcggcgaaacctattacgacttcggccactacgagccgggctcgggccgcatcggctgggtgcgccgcatcgaggatcaggccggccagtggtgccagttcgagcgcgacagccgcggccgcgtgcgcgaaatccagacctgcggcggcttgctggccgtgctcgattacgagccggaacacgggcggctcgccggggtgtcgctcgtcagcggggatcagcgccgcctcgtggtggcttacggctatgacgagcacggccagatggcgtccgtgaccgatgcgaacggcgcgctggtgcgccgcttcacctatgccgacgggcgcatgacgagccattcgaacgcgctcggcttcacgtcgggctatacgtggcaagccgtcggcggcgcgccgcgggtggttgccacccacaccagcgagggcgaggcctgggccttcgagtacgacattgaaggacgccgcacccacgtgcgtcacgccgacggccgccacgcgcaatggcgctacgacgcgcaattccagatcgtcgagtacctcgatttcgacggccggcgctacgggctcaagtacaacgacgccggcatgcccgtgatgctgacgctgcccggcgaacggaccgtgacgttcgagtacgacgatgccggccgcatcgtcgccgaaaccgatccactcggccgcaccacgaaaacgcgctacgacggcaacagcaggcggcccgtcgagatcatcgcgcccgacggcagcgcctggcacgccgaatacgaccggcaaggccggctgctcgccacccgcgatccgctcgaccgggaaaaccgctacgaatacccgaaggcgctcagcgcgctgccgatcgcgcacgtcgatgcgctgggcgggcgcaagacgttcgagtggaaccggctcggcgagctggtggcctataccgattgctcgggcaagaccacacgcaatttttacgacgcattcggtctgccgctcgcgcgcgagaacgcgctcggccaccgcgtgacgttcgacctgcgcccgaccggcgaggcgcggcgcgtcacctatcccgacggcagtacagaaagctacgaatacgacgccgccgggctgatgatccggcacgtcgggctgggcggccggacgcagattgcgctgcgcaacgcgcgtgggcagatcgtggaggcggtcgatccggccggacggcgcacctgctaccgctacgacgccgaggggcggctgcgcgagctgcaacaggggcacgcgcgttacgcgttcacctacagcgcgggcgggcggctcaccagcgaaacccggcccgacggcgtgcggcgccgcttcgaatacggcgaggccggcgatctggcggcgctcgacatcgtcggcgcggccgacgacgccacggcgaacgatcgtccggttcgcaccatccgcttcgagcgcgaccgcatgggcaatctgtgcgcgcagcacacgcccaccgaggtgacgcgctacacgcgcgacaccggcggccgcctgctcgaagtcgcatgcgtgccgaccgcggccgggctggcgctcggcatcgcgcccgacacgctgaccttcgaatacgacaaggccgggcggctgagtgccgaacacggcgcgaacggcagcgtccgatacacgctcgacgcgctcgacaacgtgatgaagctcgccctgccgcacgagcagacgctgcagatgctgcgctacggctcggggcacgtgcatcagatccgctgcggcgaccaggtggtcagcgatttcgagcgcgacgacctgcatcgcgagctgacgcgcactcagggccgcctgaccgagcgtaccgcctacgacctgctgggccgcaagatctggcaatcggccggcttccagcccgacgcgcttgcgcgcgggcagggccaggtgtggcgcaactacggctacgacgccgccggcgaactggccgagagccacgatagcctgcgcggcagcacgcagttcagctacgatccggccggctatctgacgcagcgcgtcaataccgccgaccggcagctcgaatcgttcgcctgggatgccgccggcaacctgctcgacgatgcgcagcgccgcagccgcggttatgtcgagggcaaccggctgcgcatgtggcagaacctgcgcttcgaatacgacccgttcggcaatctcgcgaccaagctgcgcggcgcgaaccagcgccagcagttcacttacgacgggcaggatcggctcgtggcggtgcgcacgcaggacgcgcgcggcgtggtggagacgcgtttcgcctacgatccgctggggcggcgcatcgccaagacggatattgtgcgcgacgcgcgcggcgtagcgctgcgcgaggaaacgaagcggttcgtgtgggaggggctgcggctcgcgcaggaggtgcgcgacacgggcgtgagcagctacgtgtacagcccggacgcgccctatacgcccgcggcgcgcgtggatgccgtgctggccgaggccatggccgccgctgccatcgagcaggccagacaggcgacgcggatctatcactttcataccgatgtgtcgggcgcaccgcaagaagcgacgaacgaggctggcgacattgtttgggccggccaatactcagcctggggcaaggtggcgccgaaccagcatgcccccgcccggatcgatcagccgctccgctacgccggacaatatgccgacgacagtaccgagctgcactacaacacgtttcgtttctacgatccggacgtcggccggtttatcaatcaggatccaatcgggttgatgggggggctgaatctttaccaatatgcacccaactcgatcgcatggaccgactggtgggggctggccggcagctatacgctcggttcctatcaaatttctgcgcctcaacttccggcctacaatggacagactgttgggaccttctactacgtgaacggcgcgggcgggctcgaatcgaggacattctcttccggagggccgaccccttatccaaattatgccaatgccgggcacgtggagggccagtccgcgctgttcatgagggataacggaatttcagacggactggttttccacaacaaccctgagggcacttgcggattctgcgttaatatgaccgaaacgcttttgcctgaaaattccaaacttaccgtcgttccgcccgagggcgcgatcccggtcaagcggggcgcgacgggcgaaacgagaacatttacggggaacagcaagtctccgaagtcccctgtcaaaggagaatgttga

SEQ ID NO: 134 - protein, 1425 aa, Burkholderia glumae; identical to SEQ ID NO: 132

SEQ ID NO: 135 - DNA, 4270 bp, Burkholderia glumae
gtgtacgaagcggcccgcgtcaccgacccgatcgaacacaccagcgcgctgaccggctttctggtgggcgccgtgctcggcattgccctgatcgccgcggtggcgttcgccaccttcacctgcggcttcggcgtggcgctgctggccggcatggccgccggcatcggcgcgcaggtgctgttgtcgttaggagaatcgatcgggaagatgttcagttcgcaatccggcgcgatcacgctcggctcgccgaacgtctatgtgaacggcaagccgaccgcctacgccatgctcagcagcgtgacgtgcagcaagcacaacccgacgccgctcgtcgcgcaggggtccaccaacatcttcatcaacggcaagccggccgcccgcaaggacgacaagatcacctgcggcgcgaccatctccgacggctcgcacgacacctatttccacggcggcacccagacctgcctgccgatcgacgacgaagtgccgccgtggctgcgcaccgccaccgactgggcgttcgcgctggccgggctggtgggcgggctcggcggcctgctcaaggaagcgggcgggctgtcgcgcgcggtgatgccgtgcgcggcgaagttcatcggcggctacgtgctcggcgaggcggcgagccgctacgtggtcggcccggccatcaacagcgcgatcggcgggatgttcggcaacccggtggacgtcaccaccgggcgcaagatcctgctggcggaatcggaaaccgattacgtggtgcccagcccgatgccggtggcgatccggcgcttctattcgagcgacctcgactacgtcggcacgctcgggcgcggctgggtgctgccgtgggaactgcggctgcacgcgcgcgacgggcggctctggtacaccgacgcgcaggggcgcgagagcggcttcccgatgctccagccgggccatgccgcgttcagcgaggccgaccagcgctatctgacctgcaccccggatggccgctacatcctgcacgacctcggcgaaacctattacgacttcggccactacgagccgggctcgggccgcatcggctgggtgcgccgcatcgaggatcaggccggccagtggtgccagttcgagcgcgacagccgcggccgcgtgcgcgaaatccagacctgcggcggcttgctggccgtgctcgattacgagccggaacacgggcggctcgccggggtgtcgctcgtcagcggggatcagcgccgcctcgtggtggcttacggctatgacgagcacggccagatggcgtccgtgaccgatgcgaacggcgcgctggtgcgccgcttcacctatgccgacgggcgcatgacgagccattcgaacgcgctcggcttcacgtcgggctatacgtggcaagccgtcggcggcgcgccgcgggtggttgccacccacaccagcgagggcgaggcctgggccttcgagtacgacattgaaggacgccgcacccacgtgcgtcacgccgacggccgccacgcgcaatggcgctacgacgcgcaattccagatcgtcgagtacctcgatttcgacggccggcgctacgggctcaagtacaacgacgccggcatgcccgtgatgctgacgctgcccggcgaacggaccgtgacgttcgagtacgacgatgccggccgcatcgtcgccgaaaccgatccactcggccgcaccacgaaaacgcgctacgacggcaacagcaggcggcccgtcgagatcatcgcgcccgacggcagcgcctggcacgccgaatacgaccggcaaggccggctgctcgccacccgcgatccgctcgaccgggaaaaccgctacgaatacccgaaggcgctcagcgcgctgccgatcgcgcacgtcgatgcgctgggcgggcgcaagacgttcgagtggaaccggctcggcgagctggtggcctataccgattgctcgggcaagaccacacgcaatttttacgacgcattcggtctgccgctcgcgcgcgagaacgcgctcggccaccgcgtgacgttcgacctgcgcccgaccggcgaggcgcggcgcgtcacctatcccgacggcagtacagaaagctacgaatacgacgccgccgggctgatgatccggcacgtcgggctgggcggccggacgcagattgcgctgcgcaacgcgcgtgggcagatcgtggaggcggtcgatccggccggacggcgcacctgctaccgctacgacgccgaggggcggctgcgcgagctgcaacaggggcacgcgcgttacgcgttcacctacagcgcgggcgggcggctcaccagcgaaacccggcccgacggcgtgcggcgccgcttcgaatacggcgaggccggcgatctggcggcgctcgacatcgtcggcgcggccgacgacgccacggcgaacgatcgtccggttcgcaccatccgcttcgagcgcgaccgcatgggcaatctgtgcgcgcagcacacgcccaccgaggtgacgcgctacacgcgcgacaccggcggccgcctgctcgaagtcgcatgcgtgccgaccgcggccgggctggcgctcggcatcgcgcccgacacgctgaccttcgaatacgacaaggccgggcggctgagtgccgaacacggcgcgaacggcagcgtccgatacacgctcgacgcgctcgacaacgtgatgaagctcgccctgccgcacgagcagacgctgcagatgctgcgctacggctcggggcacgtgcatcagatccgctgcggcgaccaggtggtcagcgatttcgagcgcgacgacctgcatcgcgagctgacgcgcactcagggccgcctgaccgagcgtaccgcctacgacctgctgggccgcaagatctggcaatcggccggcttccagcccgacgcgcttgcgcgcgggcagggccaggtgtggcgcaactacggctacgacgccgccggcgaactggccgagagccacgatagcctgcgcggcagcacgcagttcagctacgatccggccggctatctgacgcagcgcgtcaataccgccgaccggcagctcgaatcgttcgcctgggatgccgccggcaacctgctcgacgatgcgcagcgccgcagccgcggttatgtcgagggcaaccggctgcgcatgtggcagaacctgcgcttcgaatacgacccgttcggcaatctcgcgaccaagctgcgcggcgcgaaccagcgccagcagttcacttacgacgggcaggatcggctcgtggcggtgcgcacgcaggacgcgcgcggcgtggtggagacgcgtttcgcctacgatccgctggggcggcgcatcgccaagacggatattgtgcgcgacgcgcgcggcgtagcgctgcgcgaggaaacgaagcggttcgtgtgggaggggctgcggctcgcgcaggaggtgcgcgacacgggcgtgagcagctacgtgtacagcccggacgcgccctatacgcccgcggcgcgcgtggatgccgtgctggccgaggccatggccgccgctgccatcgagcaggccagacaggcgacgcggatctatcactttcataccgatgtgtcgggcgcaccgcaagaagcgacgaacgaggctggcgacattgtttgggccggccaatactcagcctggggcaaggtggcgccgaaccagcatgcccccgcccggatcgatcagccgctccgctacgccggacaatatgccgacgacagtaccgagctgcactacaacacgtttcgtttctacgatccggacgtcggccggtttatcaatcaggatccaatcgggttgatgggggggctgaatctttaccaatatgcacccaactcgatcgcatggaccgactggtgggggctggccggcagctatacgctcggttcctatcaaatttctgcgcctcaacttccggcctacaatggacagactgttgggaccttctactacgtgaacggcgcgggcgggctcgaatcgaggacattctcttccggagggccgaccccttatccaaattatgccaatgccgggcacgtggagggccagtccgcgctgttcatgagggataacggaatttcagacggactggttttccacaacaaccctgagggcacttgcggattctgcgttaatatgaccgaaacgcttttgcctgaaaattccaaacttaccgtcgttccgcccgagggcgcgatcccggtcaagcggggcgcgacgggcgaaacgagaacatttacggggaacagcaagtctccgaagtcccctgtcaaaggag

SEQ ID NO: 136 - protein, 2358 aa, Streptomyces rubrolavendulae
MSSSDAGRAFGVPENVLARFTRYPGGARRRAGRTARARRLGIVLSAVLSATLLPAEAWAIAPPAPRTGPTLDALQQEEEVDPDPAAMEELDDWDGGPVEPPADYTPTEVTPPTGGTAPVPLDSAGEELVPAGTLPVRIGQASPTEEDPAPPAPSGTWDVTVEPRATTEAAAVDGAIIKLTPPASGSTPVDVELDYGRFEDLFGTEWSSRLKLTQLPECFLTTPELEECGTPITIPTSNDPATGTVRATVDPADGQPQGLAAQSGGGPAVLAATDSASGAGGTYKATSLSATGSWTAGGSGGGFSWSYPLTIPDTPAGPAPKISLSYSSQSVDGRTSVANGQASWIGDGWDYHPGFVERRYRSCNDDRSGTPNNDNSADKEKSDLCWASDNVVMSLGGSTTELVRDDTTGTWVAQNDTGARIEYKDKDGGALAAQTAGYDGEHWVVTTRDGTRYWFGRNTLPGRGAPTNSALTVPVFGNHTGEPCHAATYAASSCTQAWRWNLDYVEDVHGNAMVVDWKKEQNRYAKNEKFKAAVSYDRDAYPTQILYGLRADDLAGPPAGKVVFHAAPRCLESAATCSEAKFESKNYADKQPWWDTPATLHCKAGDENCYVTSPTFWSRVRLSAIETQGQRTPGSTALSTVDRWTLHQSFPKQRTDTHPPLWLESITRVGFGRPDASGNQSSKALPAVTFLPNKVDMPNRVLKSTTDQTPDFDRLRVEVIRTETGGETHVTYSAPCPVGGTRPTPASNGTRCFPVHWSPDPAAFSDENLDKSGYEPPLEWFNKYVVTKVTEMDLVAEQPSVETVYTYEGDAAWAKNTDEYGKPALRTYDQWRGYASVVTRTGTTANTGAADATEQSQTRTRYFRGMSGDAGRAKVHVTLTDVTGTATTVEDLLPYQGMAAETLTYTKAGGDVAARELAFPYSRKTASRARPGLPALEAYRTGTTRTDSIQHISGDRTRAAQNHTTYDDAYGLPTQTYSLTLSPNDSGTLVAGDERCTVTTYVHNTAAHIIGLPDRVRATTGDCAAAPNATTGQIVSDSRTAYDALGAFGTAPVKGLPVQVDTISGGGTSWITSARTEYDALGRATKVTDAAGNSTTTTYSPATGPAFEVTVTNAAGHATTTTLDPGRGSALTVTDQNGRKTTSTYDELGRATGVWTPSRPVNQDASVRFVYQIEDSKVPAVHTRVLRDAGTYEESIELYDGFLRPRQTQREALGGGRIVTETLYNANGSAKEVRDGYLAEGEPARELFVPLSLDQVPSATRTAYDGLGRPVRTTTLHRGVPRHSATTAYGGDWELSRTGMSPDGTTPLSGSRAVKATTDALGRPARIQHFTTQNVSAESVDTTYTYDPRGPLAQVTDAQQNTWTYTYDARGRKTSSTDPDAGAAYFGYNALDQQVWSKDNQGRLQYTTYDVLGRQTELRDDSASGPLVAKWTFDTLPGAKGHPVASTRYNDGAAFTSEVTGYDTEYRPTGNKVTIPSTPMTTGLAGTYTYASTYTPTGKVQSVDLPATPGGLAAEKVITRYDGEDSPTTMSGLAWYTADTFLGPYGEVLRTASGEAPRRVWTTNVYDEDTRRLTRTTAHRETAPHPVSTTTYGYDTVGNITSIADQQPAGTEEQCFSYDPMGRLVHAWTDGNSAVCPRTSTAPGAGPARADVSAGVDGGGYWHSYAFDAIGNRTKLTVHDRTDAALDDTYTYTYGKTLPGNPQPVQPHTLTQVDAVLNEPGSRVEPRSTYAYDTSGNTTQRVIGGDTQTLAWDRRNKLTSVDTNNDGTPDVKYLYDASGNRLVEDDGTTRTLFLGEAEIVVNTAGQAVDARRYYSSPGAPTTIRTTGGKTTGHKLTVMLSDHHSTATTAVELTDTQPVTRRRFDPYGNPRGTEPTTWPDRRTYLGVGIDDPATGLTHIGAREYDASTGRFISVDPVMDLTDPLQMNGYTYANADPINNSDPTGLLLDARGGGTQKCVGTCVKDVTNRKGIPLPPGEEWKHEGEAQTDFNGDGFITVFPTVNVPAKWKKAKKYTEAFYKAVDTACFYGRESCADPEYPSRAHSINNWKGKACKAVGGKCPERLSWGEGPAFAGGFAIAAEEYAGRGGYRGGGARRGSPCKCFLAGTEVLMADGSTKSIEDIKLGDEVVATDPVTGEAGAHPVSALIATENDKRFNELVIITSEGVERLTATHEHPFWSPSEGEWLEAGELRTGMTLRSDSGETLVVAGNRAFTQRARTYNLTVADLHTYYVLAGQTPVLVHNANCGPHLKDLQKDYPRRTVGILDVGTDQLPMISGPGGQSGLLKNLPGRTKANGEHVETHAAAFLRMNPGVRKAVLYIDYPTGTCGTCRSTLPDMLPEGVQLWVISPRRTEKFTGLPD

SEQ ID NO: 137 - DNA, 7077 bp, Streptomyces rubrolavendulae
atgtcctcgtccgatgcgggacgcgccttcggcgtgcccgaaaacgtcctggcgcgtttcacgcggtatcccggcggggcgcgacgccgtgccgggcgcacggcgcgcgcccggcgcctgggcatcgtgctgtccgccgtcctctcggcgaccctgctgcccgccgaggcatgggccatcgcgcccccggcgccgcgcaccggtccgaccctggacgccctccagcaggaggaggaggtcgatccggacccggccgccatggaagagctggacgactgggacggtgggccggtcgagcccccggccgactacacccccaccgaggtcacgcctcccaccggcggcaccgccccggtgccgctggacagcgcgggcgaggaactggtcccggccgggaccctgcccgtgcgcatcggccaggcgtcccccaccgaggaggacccggcacccccggcacccagcggcacgtgggacgtcaccgtggagccccgcgccaccaccgaggcggccgccgtggacggcgccatcatcaagctcaccccgcccgccagcggctccacaccggtcgacgtggaactcgactacggccggttcgaggacctgttcggcaccgagtggtcctcccggctcaagctgacgcagctcccggagtgcttcctcacgacgcccgagctggaggagtgcggcacccccatcaccatcccgacgagcaacgacccggccaccgggacggtccgggccaccgtcgacccggccgacgggcagccgcagggcctggccgcgcagtcgggcggcggtcccgccgtcctcgccgcgaccgactcggcgtccggcgccggcggcacgtacaaggcgacctccctctcggccaccggctcctggacggccggcggcagcggcggcggcttctcctggtcgtatccgctcaccatcccggacaccccggccggccccgcgccgaagatctccctgtcgtactcctcccagtccgtcgacggccgcacctccgtcgccaacggccaggcgtcgtggataggcgacggctgggactaccaccccggcttcgtcgagcgccgctaccgctcctgcaacgacgaccgctccggcaccccgaacaacgacaacagtgcggacaaggagaagtccgacctgtgctgggcgagcgacaacgtcgtgatgtcgctcggcggctccaccaccgaactcgtccgcgacgacacgaccggcacgtgggtcgcgcagaacgacaccggtgcccggatcgagtacaaggacaaggacggcggagccctggccgcccagaccgccggctacgacggcgagcactgggtcgtcaccacccgcgacggaacccgctactggttcggccgcaacaccctccccggccgcggcgcccccacgaactccgccctcaccgtccccgtcttcggcaaccacaccggcgagccctgccacgccgccacctacgccgcctcctcctgcacccaggcgtggcgctggaacctcgactacgtcgaggacgtccacggcaacgcgatggtcgtcgactggaagaaggagcagaaccggtacgcgaagaacgagaagttcaaggcggctgtctcctacgaccgcgacgcgtatccgacgcagatcctctacggcctgcgcgccgacgacctggcgggcccgcccgccggcaaggtcgtcttccacgccgccccgcgctgcctcgaaagcgcggccacctgctccgaagccaagttcgagtccaagaactacgcggacaagcagccctggtgggacacaccggccaccctgcactgcaaggccggtgacgagaactgctacgtcacctcgccgacgttctggagccgcgtccgcctgtcggcgatcgagacgcagggtcagcgcacgcccggctcgacggcgctgtccacggtcgaccgctggaccctgcaccagtcgttcccgaagcagcgcaccgacacccacccgccgctctggctggagtcgatcacccgcgtgggcttcggccggccggacgcctccggcaaccagtcgagcaaggccctcccggcggtgaccttcctgcccaacaaggtcgacatgccgaaccgcgtgctgaagagcacgacggaccagacgcccgatttcgaccgcctgcgcgtcgaggtcatccgcacggagaccggcggcgagacccatgtgacgtactccgccccctgccccgtcggcggcacccgccccaccccggcctccaacggcacccgctgcttcccggtccactggtcccccgacccggcggccttctccgacgagaacctggacaagagcggctacgagccgcccctcgagtggttcaacaagtacgtcgtcaccaaggtcaccgagatggacctcgtggcggagcagcccagcgtcgagaccgtctacacctacgagggcgacgccgcctgggcgaagaacaccgacgagtacggcaagcccgccctgcgcacctacgaccagtggcgcggctacgcgagcgtcgtcacccgcacgggcaccacggccaacaccggcgccgccgacgccaccgagcagtcccagacccgcacccggtacttccgcggcatgtccggcgacgcgggccgcgccaaggtgcacgtcacgctcacggacgtgaccggcaccgcgaccaccgtcgaggacctgctcccgtaccagggcatggccgccgagacccttacctacaccaaggcgggcggcgacgtcgccgcccgcgagctggccttcccctacagcaggaagaccgcctcccgcgcccgccccggcctccccgccctggaggcgtaccgcacgggcacgacgcgcacggactccatccagcacatcagcggcgaccggacgcgcgccgctcagaaccacaccacatacgacgacgcgtacggcctgcccacccagacctactcgctgacactctcgccgaacgactccggcacccttgtcgccggtgacgagcggtgcaccgtcacgacgtacgtccacaacaccgccgcgcacatcatcggcctccccgaccgcgtccgcgccacgacgggcgactgcgccgccgcgccgaacgccaccaccggccagatcgtctccgacagccgcaccgcgtacgacgcgctcggcgccttcggcacggccccggtcaagggcctgccggtccaggtggacacgatctccggaggcggcacgagctggatcacctcggcgcgcacggagtacgacgcgctgggccgtgcgaccaaggtcaccgacgcggcgggcaactccaccacgaccacgtacagcccggcgaccggccccgcgttcgaggtcaccgtgaccaacgcggctggtcatgccacgaccaccaccctcgaccccggtcgcggctcggcgctgaccgtcaccgaccagaacggccgcaagaccaccagcacgtacgacgaactcggccgggccaccggcgtgtggacgccctcccgcccggtgaaccaggacgcgtccgtgcgcttcgtctaccagatcgaggacagcaaggtcccggcggtgcacactcgggtcctgcgcgacgccggtacgtacgaggagtcgatcgagctctacgacggcttcctccgcccccgtcagacccagcgcgaggcgctgggcggcggccgaatcgtcaccgagaccctctacaacgccaacggctctgcgaaggaagtgcgcgacggctacctggcggagggcgagcccgcgcgggaactgttcgtcccgctctccctcgaccaggtgccgagcgcgacgaggacggcctatgacggcctgggccggcccgtccggacgacgaccctccacaggggagtcccccggcactccgccaccacggcgtacggcggcgactgggaactgagccgcaccggcatgtcgcccgacggaacgacgccgctctctggcagccgcgccgtgaaggcgacgacggacgcgctcggccgcccggcccgcatccagcacttcaccacccagaacgtgtcggccgagagcgtcgacaccacgtacacctacgacccccgcggcccccttgcccaggtcaccgacgcccagcagaacacctggacgtacacgtacgacgcccgtgggcgcaagacgtcctccaccgacccggacgcgggcgccgcctacttcggctacaacgcgctggaccagcaggtctggtcgaaggacaaccagggccgcctgcagtacacgacgtacgacgtcctgggccgccagaccgagctgcgcgacgactccgcgtccggcccgctggtggcgaagtggaccttcgacaccctgccgggcgccaagggccacccggtcgcgtcgacccgctacaacgacggcgccgcgttcaccagcgaggtgaccggttacgacaccgagtaccgtccgaccggcaacaaggtcaccatccccagcaccccgatgaccacgggcctcgccggcacgtacacgtacgccagcacgtacaccccgaccggcaaggtccagtccgtcgacctgcccgcgacgcccggcgggctcgccgcggagaaggtgatcacccgctacgacggcgaggactcgcccaccacgatgtcgggcctggcctggtacacggccgacaccttcctcggcccgtacggggaagtgctgcgcacggcgtcgggcgaggccccgcgccgcgtgtggacgaccaacgtctacgacgaggacacccgccgcctcaccaggaccaccgcgcaccgggagacggctccccacccggtcagcacgaccacctacggctacgacacggtcggcaacatcacgtccatcgccgaccagcagccggcgggtaccgaggagcagtgcttctcgtacgacccgatggggcgcctcgtccacgcctggacggacggcaacagcgccgtctgccccaggacgtccacggcaccgggcgccggcccggcccgcgccgacgtctcggccggtgtcgacggcggcggatactggcactcgtacgcgttcgacgcgatcggcaaccggacgaagctgaccgtccacgaccgcaccgacgcggccctggacgacacgtacacctacacctacggcaagaccctgccgggtaacccgcagccggtccagccgcacaccctcacccaggtcgacgcggtgctcaacgagcccggatcgagagtcgaaccgcgctccacatacgcctacgacacctccggcaacaccacccagcgcgtcatcggcggcgacacccagaccctggcctgggaccgccgcaacaagctgacgtccgtcgacacgaacaacgacggcacaccggacgtgaagtacctgtacgacgcgtcgggcaaccgcctggtcgaggacgacggcaccacgcgcaccctcttcctcggcgaggccgagatcgtcgtcaacacggccggccaggccgtggacgcgcgccgctactacagcagccccggcgccccgacgacgatccgcacgaccggcggcaagaccacgggccacaagctgaccgtcatgctgtcggaccaccacagcacggcgacgaccgcggtcgagctgaccgacacccagccggtcacccgccgccgcttcgacccgtacggcaacccccgcggcaccgagccgaccacctggcccgaccgccgcacctacctgggcgtcggcatcgacgaccccgccacgggcctgacccacatcggcgcccgcgaatacgacgcatcgacgggccgcttcatctccgtcgatccggtcatggacctcacggacccgctccagatgaacgggtacacctacgccaacgcggacccgatcaacaacagcgaccccaccggactgttgctcgacgcccgaggcggcggcactcagaagtgcgtgggaacctgcgtcaaggacgtcacgaaccgaaagggaattccgctcccgcctggcgaggagtggaagcatgaaggggaggcgcaaaccgatttcaacggtgacggcttcatcaccgtcttcccgaccgtgaatgttccggcgaagtggaagaaggcgaagaagtacacggaggctttctacaaggcggttgatactgcttgcttctatggacgcgaaagctgtgcggatccggagtacccttcgcgggcgcatagcatcaacaactggaagggaaaggcatgcaaagccgtagggggaaaatgccctgagaggttgtcgtggggggagggtccggcgttcgctggtggcttcgcgatagcagcggaagagtatgcggggagagggggctaccggggcggtggggcgaggagggggtcgccctgtaagtgcttccttgccggcaccgaggtgctcatggcggatggcagcactaaaagtatcgaggacatcaagctcggtgacgaagtggttgcgactgatccggtaaccggtgaggccggtgcgcaccctgtctcggcgctgatcgccaccgagaacgacaagcgtttcaacgagctggtcattatcaccagcgagggtgtagagcgtcttaccgcaacgcatgagcaccccttctggtcgccatccgaaggggagtggttggaggcgggtgagctgcgcactggcatgacgctgcgctccgactctggcgaaactctcgtagtcgcaggaaaccgcgccttcacccagcgagcccggacctacaacctcacggttgcagacctccacacgtactatgtgctggcgggccagactccggtactggttcacaatgcaaactgtggacctcacctgaaggacctgcaaaaggactacccccggcgcactgtgggcatccttgacgtcggaactgatcagctcccgatgattagcggcccaggtggccagtcgggacttctcaagaacctcccaggtcgtacgaaggccaacggggagcacgtggagactcacgcagcagcgttcttgcgtatgaacccgggtgtcagaaaggccgtgctctacatcgactacccgacggggacctgcggaacatgtagaagtacattgcctgacatgctgcccgagggtgttcagttgtgggtgatctcgccgcgtaggactgaaaaattcacgggacttcctgactga

SEQ ID NO: 138 - protein, 115 aa, Unknown
  Plantactinospora sp. BC1
MGDRLPAFVDGGDTLGIFSRGGIERDLASGVAGPASSLPKGTPGFNGLVKSHVEGHAAALMRQNGIPNAELYINRVPCGSGNGCAAMLPHMLPEGATLRVYGPNGYDRTFTGLPD

SEQ ID NO: 139 - DNA, 348 bp, Unknown
  Plantactinospora sp. BC1
ctgggtgaccggctccctgccttcgtggacggtggagacacgttgggcatcttttctcgcggaggtattgagcgggacctcgccagcggagttgcgggtcctgcaagtagccttcctaaaggcacgcctggcttcaatggtcttgtaaagagtcatgttgaagggcatgcggctgcgctaatgagacaaaatggaattccgaacgctgagctgtatatcaacagagtgccgtgcggttcaggtaatggctgcgcagcgatgttgccgcatatgcttccggaaggtgccaccctccgcgtatatgggccgaacgggtacgatagaaccttcactggacttccggactga

SEQ ID NO: 140 - protein, 2427 aa, Kitasatospora setae
MAAVPSAEALAAKRARDTIWTPPNTPLGSQTKSVDGENLVPGRLPGPLEPEPADWTPGGPASVPAPGSADVTLGFDSAEAAAARKATGGAAPASDGAALRAGSLPVVIGAAKDAKSGAHRIRVELVDQAKSRAAHLDSPLIALTDTEPDTPPSGRTTKVSLDLKGIGAQTWADRARLVALPACALETPDRPECQQQTPVQSSVDLRSGLLTAEVILPAATEGTAPPTKSSLGSGTASGVVQAGLTTAAPAKAAPTVLAATAGASGSGGSFSATSLSPSAAWGAGSNVGNFTYSYPIQTPPSLGGTAPSVGLGYDSSAVDGKTSAQNSQSSWLGEGWGYEAGFIERGYKSCNTAGIANSSDMCWGGQNATLSLAGHSGTLVRDDTTGVWHLQSDDGTKIEQLTGAPNGLQNGEHWRITTTDGTQFYFGRNHLPGGDGTDPASNSAFKEPVYSPKSGDPCYNSSTATGSWCTMGWRWNLDYAVDVHGNLITYTYAQETNYYSRGAGQNSGSGTLTDYTRAGYLTQIAYGQRLSEQVTAKGAAKAAALITFTAAERCVPSGSITCTEAQRTTANASYWPDTPLDQVCASTGTCTRAGPTFFTTKRLASLTTQVLVSGAYRTVDTWTLTHSFKDPGDGNAKSLWLDSIQRTGTNGQTAVTMPPVTFTAVMKPNRVDGDLTLKDGTKVTVTPFNRPRLQQVTTETGGQINVVYTTSSDAAHPACSRLAGTMPAAADGNTLACAPVKWYLPGSSSPDPVDDWFNKYLISAVTEQDAISGTTLIKATNYTYNGDAAWHRNDAEFTDAKTRTWDGFRGYQSVTSTTGSAYPGEAPRTQQTATYLRGMDGDVKADGSTRSVQVANPLGGPALTDSPWLAGSSFATQTYDQAGGTVISANGSVAGGQQVTATHAQSGGMPALVARYPASQVTTTSKSKLSDGTWRTNTTVSTSDPAHANRPLSSDDKGDGTPGAELCSTNGYATGTNPMMLNILAERTVTKGACGTPVTSANTVSSARTLYDGKPYGQAGDLAESTSALTLDHYDTGGNPVYVHTAASTFDAYGRLTSVSEANGATYDAAGNQLTAPNLTPATTRTAYTPATGAIATTVTQTTPTGWTTTLTQDPGRAEALVSTDANGRATTQQYDGLGRLTAAWSPERATNLTPSQKFSYAVNGTTGPSVVTSQWLKEAGGYAYKNELYDGLGRLRQVQRTSDTYSGRLITDTVYDSHGWPVKTASPYYEKTTAPNSTVYLPQDSQVPAQTWVTFDGIGRTTRSAFVSYGQQQWATTTAYPGADRTDVTPPNGKYPTSTFTDGRNQVSALWQYRTATPTGNPADATVTTYTYDAANRPATRKDAAGNTWSYGYDLRGRQTTVTDPDTGTTTTAYDVNSRAVSTTDGKGNTLVVSYDLIGRKTGLYQGSIAPANQLAGWTYDTLPGGKGKPTSSTRYVGGAGGSAYTQAVTGYDAGYRPTGTSVTIPASEGKLAGTYTTGLTYNPVLGTLKQTDLPAIGAAPAESVMYTYNISGVLQKSYSDTYYVYDVQYDAFGRPVRTTTGDAGTQVVSTQLDKTDYTYNQAGDVTSVTDVQNGTATDAQCFTYDHLGRLTQAWTDTAGSTSTTSGTWTDTSGTVHNSGSSQSVPALGACANANGPASTGSPAKLSVGGPSPYWQSYGYDSTGNRTTLVQHDTTGNTTKDTTTTQTFGPAGSVNTATGAPNTGGGTGGPHALLTSSTTGPTGTQVTSYQYDQLGNTTAVTETSGTTTLAWNGEDKLASVTKTGQAQATSYLYDADGNQLIRRNPGKTTLNLGSDEVTLDTAANSLTDTRYYSAPGGISIARTTGPTGASALAYQASDPHGTANVQINVDAAQTTTRRPTDPFGNPRGTQPAPNTWAGDKGFVGGTKDDTTGLTNLGAREYQPTTGRFLNPDPLLDAGNPQQWNGYAYSDNDPVNSSDPSGLITNALADGDTYVARPAAFCVTMSCVEQTSGPGFWEDKRVGDAVFAAVVQATTQSNGNGSSQTKKEKGIWGQAWDWTKKNGGAILGALVEGAVFSTCFIGAGFAAPATGGITVIAGAAACGAVAGEAGALTTNILTPDADHSVDGITNDMVVGEITGAAVSAASEGASSLAKPAVRKLLGMEAEEGLEAAGRAATGPCNSFPAGVTVLLADGTTKPIEQIAQGDQVTATDPQTGTTQAEPVTDTIIGHDDTEFTDLTLTNDADPRAPPSEITSTTHHPYWNATTSRWTDAGDLKPGDHVRTPDGTELTVNTVYSYTTQPRTARNLTVADLHTYYVLAGNTPVLVHNTGPGCGEPGFVSDAANSLSGRRITTGQIFDASGNPIGPEITSGGGSLADRAQSYLADSPNIRNLPAKARYASADHVEAQYAVWMRENGVTDASVVINQNYVCGLPLGCQAAVPAILPRGSTMTVWYPGSGSPIVLRGVG

SEQ ID NO: 141 - DNA, 7323 bp, Kitasatospora setae
gtgctggggacagcggccgcgctcgcggtcatgatgtccatggcggcggtgccgtccgccgaggcactggccgcgaagcgggcacgcgacaccatctggacgccgcccaacaccccgctgggcagccagaccaagtccgtcgacggcgagaacctcgtcccgggccgcctgcccggccccctggagccggaaccggccgactggacacccggcggaccggcatccgtgcccgctccgggcagcgcggacgtcaccctcggcttcgactccgcggaggccgccgccgcccgcaaggccaccggcggcgccgcccccgcctccgacggcgcggccctccgcgcgggctccctccccgtcgtcatcggcgcggcgaaggacgccaagagcggcgcccaccggatccgcgtcgagctcgtggaccaggccaagagccgtgccgcacacctcgacagcccgctgatcgcactcaccgacaccgagccggacaccccgccctccggtcggaccacgaaggtgtccctcgacctgaagggcatcggcgcccagacctgggcggaccgcgcgcgactcgtcgccctgcccgcctgcgccctggagacgcccgacaggcccgagtgccagcagcagacccccgtgcagagctccgtcgacctgcgctccggactgctgacggccgaggtcattctgcccgccgccaccgagggcaccgccccgcccaccaagagctccctcggctcgggcaccgcctccggcgtcgtccaggccggcctcaccacggcggcgcccgccaaggccgcgcccacggtgctcgccgcgaccgccggcgcgtccggctcgggcggcagcttctcggcgacctcgctgtcgccctccgcggcctggggcgccggctccaacgtcggcaacttcacctactcgtacccgatccagacgcctccctcgctcggcgggaccgccccctccgtgggcctcgggtacgactcgtccgccgtcgacgggaagacctccgcgcagaactcccagtcctcctggctcggcgagggctggggctacgaggccgggttcatcgagcgcggctacaagtcctgcaacacggccggcatcgcgaactcctcggacatgtgctggggcgggcagaacgccaccctctcgctggccggccactccggcaccctggtgcgcgacgacaccaccggcgtctggcacctgcagagcgacgacggcacgaagatcgaacagctcaccggcgcgcccaacggcctgcagaacggcgagcactggcggatcaccacgaccgacggcacgcagttctacttcggccgcaaccacctgcccggcggcgacggcaccgacccggcgagcaactccgccttcaaggaaccggtgtactcgcccaagagcggcgacccctgctacaactcctccaccgccaccggctcctggtgcacgatgggctggcgctggaacctcgactacgccgtcgacgtccacggcaacctgatcacctacacctacgcccaggagaccaactactacagccgaggcgccggccagaacagcggcagcggcaccctgaccgactacacccgcgccggctacctcacccagatcgcctacggccagcgcctgagcgagcaggtcaccgccaagggcgcggccaaggccgctgccctcatcaccttcaccgccgcggaacgctgcgtcccgtccggctcgatcacctgcaccgaggcacagcgcacgaccgcgaacgcctcgtactggccggacaccccgctcgaccaggtctgcgcctccaccggcacctgcacccgggccggcccgacgttcttcaccaccaagcgcctcgcctccctcaccacccaggtcctggtctccggcgcctaccgcaccgtcgacacctggacgctcacccattccttcaaggacccgggcgacggcaacgccaagtcgctgtggctcgactcgatccagcgcaccggcaccaacgggcagaccgcggtcaccatgccgcccgtcaccttcacggcggtgatgaagccgaaccgggtggacggggacctcaccctcaaggacggcaccaaggtcaccgtcaccccgttcaaccggccccgcctccagcaggtcaccacggagaccggcggccagatcaacgtcgtctacaccacctcctccgacgccgcgcaccccgcctgctcgcgcctggccggcaccatgcccgccgcggcggacggcaacaccctcgcctgcgcccccgtcaagtggtacctgcccggatccagctccccggacccggtcgacgactggttcaacaagtacctgatcagcgccgtcaccgaacaggacgcgatcagcggcaccaccctgatcaaggccaccaactacacctacaacggcgacgccgcctggcaccgcaacgacgccgagttcaccgacgccaagacccgcacctgggacggcttccgcggctaccagtccgtcaccagcaccaccggcagcgcctacccgggcgaggcccccaggacccagcagaccgcgacctacctgcgcggcatggacggcgacgtcaaggccgacggctccacccgcagcgtccaggtcgccaacccgctcggcggcccggccctcaccgacagcccgtggctggccggctccagcttcgccacccagacctacgaccaggccggcggcaccgtcatctccgccaacggctccgtcgccggcggccagcaggtcaccgccacccacgcccagagcggcggcatgccggccctggtcgcccgctaccccgcctcccaggtcaccaccacctccaagtccaagctctccgacgggacctggcgcaccaacaccaccgtcagcaccagcgaccccgcgcacgccaaccgccccctcagcagcgacgacaagggcgacggcacccccggcgccgaactgtgcagcaccaacggctacgccaccggcaccaacccgatgatgctgaacatcctcgccgagcggacggtcaccaagggcgcctgcggcacccccgtgacctcggccaacaccgtctcctccgcccgcaccctctacgacggcaagccctacggccaggccggcgacctcgccgagtccaccagcgccctgaccctggaccactacgacaccggcggcaaccccgtctacgtccacaccgccgcctccaccttcgacgcctacggccggcttaccagcgtcagcgaggccaacggcgccacctacgacgccgcgggcaaccagctcaccgcgcccaacctcacccccgccaccacccgcaccgcctacaccccggccaccggcgccatcgccaccaccgtcacccagaccacgcccaccggctggaccaccaccctcacccaggacccgggccgcgccgaagctctggtctccaccgacgccaacggccgcgccaccacccagcagtacgacggcctcggccgcctgaccgccgcctggtcaccggagcgcgcgaccaacctcacccccagccagaagttctcctacgcggtcaacggcaccaccggcccctccgtcgtcacctcccagtggctcaaggaagccggcggctacgcgtacaagaacgagctgtacgacggcctcggccgcctgcgccaggtccagcgcaccagcgacacctactccgggcggctgatcaccgacaccgtctacgactcgcacggctggcccgtcaagaccgccagcccgtactacgagaagaccaccgcgcccaacagcaccgtctacctgccgcaggactcccaggtgcccgcccagacctgggtcaccttcgacggcatcggccggaccacccgctccgcgttcgtctcctacggacagcagcagtgggccaccaccaccgcctaccccggcgccgaccgcaccgacgtcaccccgcccaacggcaaatacccgaccagcaccttcaccgacggccgcaaccaggtcagcgccctgtggcagtaccgcaccgccacccccaccggcaacccggccgacgcgaccgtcaccacctacacctacgacgccgccaaccggcccgccacccgcaaggacgccgccgggaacacctggagctacggctacgacctgcgcggccgccagaccaccgtcaccgaccccgacaccggcaccaccaccaccgcctacgacgtcaactcgcgcgccgtctccaccaccgacggcaagggcaacaccctcgtcgtcagctacgacctgatcggccgcaagaccggcctctaccagggcagcatcgccccggccaaccagctcgccggctggacgtacgacaccctgccgggcggaaagggcaagcccacctcctccacccgctacgtcgggggcgccggcggctcggcctacacccaggccgtcaccggctacgacgccggctaccggcccaccggcacctcggtgacgatccccgccagcgaaggcaagctcgccggtacctacaccaccggcctgacgtacaacccggtcctcggcacgctcaagcagaccgacctgccggccatcggcgcggcgcccgccgagagcgtcatgtacacctacaacatctccggcgtcctgcagaagtcctacagcgacacctactacgtctacgacgtgcagtacgacgccttcggccgcccggtccgcacgaccaccggcgacgccggaacccaggtcgtctccacccagctcgacaagaccgactacacctacaaccaggccggcgacgtcacctcggtcaccgacgtccagaacggcaccgccaccgacgcccagtgcttcacctacgaccacctcgggcgcctcacccaggcctggaccgacaccgcgggctccaccagcaccaccagcggcacctggaccgacacctccggcaccgtccacaacagcggctcctcccagtccgtccccgcactcggcgcctgcgccaacgccaacggccccgccagcaccggcagccccgccaagctctccgtcggcggcccctccccgtactggcagagctacggctacgacagcaccggcaaccgcaccaccctcgtccagcacgacaccaccggcaacaccaccaaggacaccaccaccacccagaccttcggccccgccggatcggtcaacaccgccaccggcgcccccaacaccggcggcggcaccggcggcccgcacgccctgctcaccagcagcaccaccggacccaccgggacccaggtcaccagctaccagtacgaccagctcggcaacaccaccgcggtcaccgagacgtccggaaccaccaccctcgcctggaacggcgaggacaagctcgcctccgtcaccaagaccggccaggcccaggccaccagctacctctacgacgccgacggcaaccagctcatccgccgcaaccccggcaagaccaccctcaacctcggcagcgacgaggtcaccctcgacaccgccgccaactccctcaccgacacccgctactacagcgcccccggcggcatcagcatcgcccgcaccaccggacccaccggcgcaagcgccctcgcctaccaggcctccgacccccacggcaccgccaacgtccagatcaacgtcgacgccgcccagaccaccacccgccgccccaccgaccccttcggcaacccccgcggcacccagcccgcccccaacacctgggccggcgacaagggcttcgtcggcggcaccaaggacgacaccaccggactcaccaacctcggcgcccgcgaataccaacccaccaccggccgcttcctcaaccccgacccactcctcgacgccggcaacccccagcagtggaacggctacgcctacagcgacaacgaccccgtcaacagctccgaccccagcggactcatcaccaacgccctggccgacggcgacacctacgtcgcccgccccgccgccttctgcgtcaccatgtcgtgcgtcgagcagaccagcggccccggtttctgggaggacaagcgcgtcggtgacgccgtcttcgccgccgtcgtccaggccaccacgcagagcaacggcaacgggtcatcccagaccaagaaagagaagggcatctggggccaggcctgggactggaccaagaagaacggcggcgccatcctcggagcgctggtagagggagcggtcttcagcacatgcttcatcggagctggattcgccgcacctgcaacgggaggaatcaccgtcatcgccggtgctgcggcctgcggggctgtggccggcgaggcaggggcactgaccaccaatatcctcaccccagatgccgaccactccgtcgacggcatcaccaacgacatggtcgttggtgaaatcaccggggcggctgtcagcgcagcgagcgagggcgcaagctccctcgccaagccggcggtccgcaaactcctgggcatggaagccgaggaaggactcgaggcagcaggccgcgccgccaccggaccttgcaacagtttcccggccggcgtcaccgtcctcctcgccgacggcaccaccaagcccatcgaacagatcgcccagggcgaccaggtaaccgccaccgacccgcagacaggcaccacccaggcagaacccgtcaccgacacgatcatcggccacgacgacacggaattcaccgacctcaccctcaccaacgacgcagacccccgcgccccgcccagcgagatcacctccaccacccaccacccctactggaacgccaccaccagccgctggaccgatgccggcgacctcaagcccggcgaccacgtccgcacccccgacggcaccgaactgaccgtcaacaccgtctacagctacaccacacaaccccggaccgcgcgcaacctcaccgtcgcagacctccacacgtactatgtgctcgctggaaatacgccggtcctagtgcataacaccggcccgggatgtggtgagccgggattcgttagtgacgctgctaattctctctcgggcaggcgcatcaccacgggacaaatatttgatgcgagcgggaatccgatcgggcctgagatcacgagcggcggcggcagtctggcagatagggcgcagagttatcttgccgactcccctaatattcgaaatctgcccgctaaggcgagatatgcgtcggctgaccacgttgaggcgcaatatgcagtgtggatgcgagaaaatggagtgaccgacgccagtgtggtcatcaatcaaaactatgtatgtgggctgcccctaggctgccaggcggcggtgcccgctatcctccctcgcggctcgaccatgacggtatggtatccagggtcaggaagtcccatcgtattgcggggagtgggttaa

SEQ ID NO: 142 - protein, 2594 aa, Unknown
  Thauera sp
MRAFRLIACLLAFSAAAAPAAADTSSMLGRLPEASARQLKERLAPRGLASAAALRQYLDASQRELDTAPEADDVPARSQRFAARAGELTALREQARRDLASLEDAAKASGSAEATQRIGRIRGQVDARFDRLEGLFTTWRNAPQGSERRQARRELRAALATLRHAGTPAPAAIPVPTLGPLQPAGEPAANPPAARLPAYAQADDATGDPFTPGGFRLMKVAALPPAVAAEAATDCSATSADLADDGKDVRLTQPIRDLAASLDYSPARILRWTQQNVAFEPYWGALKGAEGVLQTRAGNSTDQASLLIALLRASNIPARYVRGTVQLNDTAAQDDAGGRAQRWLGTKRYRASAAVLAGGGTSAGLQSIDGTVRGIRFSHVWVQACVPHGAYRGARAEAGGYRWLALDAAVKDHDYQQGIAVDVPLTDAAFYTPYLAARSDQLPHEHFAQKVAEAARATDANAALADVPYAGTPRPLRYDVLPGSLPYEVEAFTNWPGLGSSETASLPDAHRHTFTVTVRNGATTLASAALPYPQNAFKRVTLSYQPTAASQAAWNAWTGDLPAAADGSIQVVPQIKADGTVLAAGAPANALPLAGVHNVILKVSQGERSGAACINDSGNPADPKDTDGTCLNKTVYTNIKAGAYHALGLNALHTSNAFLGQRLEALAAGVQAYPVAPTPAAGAGYEATVGELLHLVLQDYLHQTEQADQRNAALRGFKSVGPYDLGLTASDLETDYLFDIPVAIKPAGVFVDFKGGLYGFVKLDTTAETAAARAAENVDLAKLSIYSGSALEHHVWQQALRTDAVSTVRGLQFAAEQGIPLVTFTAANIGQYDSLMQMSGATSMAAYKSAIQNAVKGSDNGNHGVVTVPRAQIAYADPVDPASKWTGAVYMSQNPVTGEYGAIINGTIAGGFPLLNSTPFSNLYNFDSFVPNTLLGTNGGAGAVQTLPGGTQGESSWITKAGDPVNMLTGNYTLQARDFTIKGRGGLPIVLERWFNAQNATDGPFGFGWTHSFNHQLRFYGIESGQSKVGWVDGTGAQRFYAVAAAGSIAPGTTLAAQAGVFTTLSRLADGRFQVRETNGLTYSFESLTSPTTPPAAGSEPRARLLAIADRHGNTLTLNYSGSQLASVSDSLGRTVLSFTWNGNRIGKVKDVSGREVNYAYEDGNGNLTRVTDPLGQATRYSYYTSADGAKLDHALRRHTLPRGNGMEFEYYAGGQVFRHTPFDTSGNLIPESALTFHYNSYRRESWTVDGRGAEERFLFDTHGNVIQQTAANGATHTYAYADPNDPHLRTRMTDPVGRVTQYSYTAEGYLQTLTLPSGAVQAWRDYDAFGQPRRVKDARGNWTLHHYDTAGTRTDSIRVKSGVVPTVGTAPAAANVVSWIKYQGDSVGNLTGVKRLRDWTGATLGNFASGSGPVVTTTFDAARLNVASVGRSGNRNGSQISETSPIFSHDALGRLTGGVDGRWYPVAFDYDVLDRVTRATDATGQPRRYAFDVNGNRIGTELIAGGSRIDSSVAAFDVQDRVAHVLDHAGNRVAYAYDAVGNRVSVESPDGYAIGFDYDLAGRPYSAYDEDGNRVFSAFDVAGRVRAVIDPNGAATLYDYHGDEQDGRLARVEQPAIPGQNAGRAAETDYDAGGLPIRVRQVSAGGEAREGYRFHDELGRVVRSVSAPDDVGQRLQVCYSYDALSNLTQVRAGATTDTTSAACAGSPAVQLTQSWDDFGNLLTRTDALGRVWKFEYDAHGNLVASQTPEQAKVSTRSTYRYDPALHGLLAGRSVPGSGSAGQSVSYARNALGQVIRAETRDGAGNLVVAYDYQYDAAHRVVRIVDSRGGKALDYAWTPAGRLASITLDGHVWRFQYDGVGRLAAIVAPNGATIAMARDAAGRLTERRWPDGAKSAFDWLPEGSLAAIEHSAGGSALAQFAYAYDAWGNRTSATETLAGTSRSLAYGYDALDRLKTVTTDGATETHAFDLFGNRTSKTTGGVTTDYLFDAAHQLTQVQIAGTPTERLAYDDNGNLRKHCVGSPSGSTSDCTGTTVLSLAWNGLDQLIQAARTGLPAESYAYDDAGRRVTKAVGSSATHFAYDGPDILAEYASPAGSPTAVYAHGAGIDEPLLRLTGATSTPAASAHHYAQDGLGSIVAAYGEIGASGPVSAASVSATHSYSAGSYPPAKLIDGETTGSTGFWAGSSGNFAADPAVITLELGAEKSVSRVRLHRVASYLPDYVVKDAEVQVRKPDNSWQTVGTLTNNTSEDSPEIVLTGAPGSALRVLVKGVRNGSLVLMAEVTMSADGGAASVATARYDAWGNVTQASGSIPAFGYTGREPDATGLVYYRARYYHPALGRFASRDPLGLAAGINPYAYAGGNPILYNDPDGLLAQLAWNTAASYWGQPIVQETVATIRNGAAVAAGNFVPDTVNGATGWFEQFLHQESGSFGRMDSWVDVRNPVAQDVAQDLRGVAAVGLMMTPLRYGRASNASFNPPVANLPLNTGGKTSGMLHIPGQESLSLTSGIAGPSQVVRGQGLPGFNGNQLTHVEGHAAAYMRTHKVSEAVLDINKAPCTAGSGGGCNGLLPRMLPEGAHLTIRHPNGVQVYIGTPD

SEQ ID NO: 143 - DNA, 7785 bp, Unknown
  Thauera sp
atgcgtgccttccgcctgatcgcctgccttctcgccttttcggcggcagccgcacctgctgcggctgacacgtcgtcgatgctggggcgtctgcctgaagcaagcgcccgccagctcaaggagcggttggcgccgcgtggccttgcctccgctgccgccttgcgccagtacctggacgcctcgcaacgcgagctggacaccgcaccggaagcggacgacgtacccgcccgcagccaacgctttgccgcaagggcgggcgaactcaccgcgctgcgcgaacaggcgcgccgggatctcgccagtctggaggacgccgcgaaggcgagcggctcggccgaggcgacgcagcgcatcggtcgaatccgcgggcaggtggacgcacgcttcgaccggctcgaagggctttttaccacttggcgcaatgcgccccagggcagcgaacgccgccaggcccgccgcgaactgcgtgccgcgctcgccacgctccgccatgccggcaccccggctccggctgcgattcctgttcctaccctcggccccctgcaaccggccggcgagccggctgccaacccaccggccgcgcgcttgccagcctatgcgcaagcggatgacgcgactggcgacccctttacccccggtggcttccggctgatgaaggtcgccgcactgccgccggcggtcgcggccgaggcggcaacggactgctccgccaccagcgccgacctggccgacgacggcaaggacgtgcgcctgacccagccgatccgcgacctcgcggcatcgctcgactactcaccggcacgcatcctgcgctggacgcagcagaacgtcgccttcgaaccctactggggggcactcaagggggcggaaggcgtgctgcagacgcgcgccggcaacagcaccgaccaggccagcctgctgatcgcactcttgcgggcctccaacattcccgcccgctacgtacgcggcaccgtgcagctcaacgacactgccgcgcaggacgacgcaggcgggcgggcgcagcgctggctgggcaccaagcgctaccgtgcatcggccgcggtactcgccggcggcggaacttccgccggcctgcagtcgatcgacggcaccgtccgcggcatccgcttcagccatgtctgggtccaggcctgcgttccccatggcgcttaccgcggtgcccgcgcggaagccggcggctatcgctggctggcgctggacgcggcggtgaaggaccatgactaccagcagggcatcgcggtcgatgtgccgctcaccgatgccgcgttctacacgccctatctggcggcgcgcagcgaccagttgccgcacgagcatttcgcacagaaggtggcggaggcggcgcgtgcgaccgacgccaatgcggcgctggccgacgtgccctacgccggtacgccgcggccgctgcgctacgacgtgctgcccggttcgctgccctacgaggtcgaagccttcaccaactggcccggcctcggttcgtccgaaaccgcaagcctgccggacgcacaccgccacaccttcaccgtgacggtcaggaacggcgccaccacgttggcgagcgccgcgctgccctatccgcagaacgccttcaagcgcgtcacgctgtcctatcagccgactgccgcctcgcaggcggcctggaacgcctggacgggcgatctgcccgccgcggccgacggcagcatccaggtcgtgccgcagatcaaggccgacggtaccgtgctcgccgcaggtgcgcccgccaacgcgctgccgctcgccggcgtgcacaacgtcatcctcaaggtctcgcagggcgagcgcagcggtgccgcgtgcatcaacgacagcggcaaccccgccgacccgaaggacaccgacggcacctgcctcaacaagaccgtctacaccaacatcaaggccggcgcctaccacgccctgggcctgaatgcgctgcacacctcgaatgccttcctcggccagcggctcgaagcgctggcggccggcgtgcaggcctatcccgtcgcgcccacgccggccgcgggtgccggctacgaggccacggtcggtgaattgctgcatctggtgctgcaggactacctgcaccagaccgagcaggccgaccagcgcaacgccgcgttgcgcggcttcaagagcgtggggccgtacgacctcgggctgaccgcgtccgacctcgaaaccgactacctcttcgacatcccggtcgcgatcaagccggccggcgtgttcgtggacttcaagggcggcctctacggtttcgtcaaactcgataccacggccgagacggccgcggcacgcgccgccgaaaacgtggatctggccaagctctcgatctactccggctccgcgctcgaacaccacgtctggcagcaggcgctgcgcaccgatgcggtgtccaccgtgcgtgggctgcagttcgccgccgagcagggcattccgctcgtcaccttcaccgcggccaacatcggccagtacgacagcctcatgcagatgagcggcgccaccagcatggccgcttacaagagcgcgatccagaacgcggtgaagggctcggacaacggcaaccacggcgtcgtcaccgtgccgcgcgcccagatcgcctacgccgaccccgtcgatccggcgagcaaatggaccggcgcggtctacatgtctcagaaccccgtcaccggagagtacggggcgatcatcaacggcaccatcgccggcggcttcccgctgctcaacagcacgcccttcagcaatctctacaacttcgattccttcgtgcccaacaccctccttggcacgaacgggggtgccggtgcggtgcagaccctgcccggcggcacccagggcgagagttcctggatcaccaaggccggcgacccggtgaacatgctcaccggcaactacacgctgcaggcacgcgacttcaccatcaagggccggggcggactgccgatcgtgctggagcgctggttcaacgcgcagaacgccaccgacgggccgttcggcttcggctggacgcacagcttcaaccatcagttgcgtttctacggcatcgagagcggccagtccaaggtcggctgggtggacggcactggcgcccagcgcttctacgccgtggccgccgccggcagcattgcgccgggcacgacgctggccgcgcaggccggggtgttcacgacgctgtcgcgtctggccgacggccgcttccaggtgcgcgagaccaacggcctcacctacagcttcgaatcgctcacgagcccgaccaccccgccggccgcgggcagcgaaccgcgcgcaagactgctggccatcgccgaccgccacggcaacaccctgacgctcaactacagcggcagccagcttgcctcggtgagcgacagcctcggccgcacggtgctcagcttcacctggaacggcaaccgcatcggcaaggtgaaggacgtcagcggacgggaagtgaactacgcctacgaggacggcaacggcaacctcacgcgcgtcaccgatccgctgggtcaagccacgcgctacagctactacaccagtgccgacggtgccaagctcgaccacgccctgcgccgccacaccctgccgcgcggcaacggcatggagttcgagtactacgccggtggccaggtcttccgccacacgccgttcgacaccagcggcaacctcattcccgaatcggcgctgaccttccactacaacagttatcggcgcgagagctggacggtcgatggccgcggtgccgaggagcgcttcctgttcgacacgcacggcaacgtgatccagcagaccgccgccaacggtgccacccacacctacgcgtacgccgacccgaacgatccgcatctgcgcacgcgcatgacagacccggtcggccgcgtcacccagtacagctataccgccgaaggctatctgcagaccctgacgctgccgtcgggcgccgtgcaggcgtggcgcgactacgacgccttcggccagccccgccgcgtcaaggacgcgcgcggcaactggacgctccaccactacgacaccgccgggacacggaccgactccatccgggtcaaatcgggcgtggtccccaccgtcggcaccgcgcctgccgcggccaacgtcgtttcctggatcaagtaccagggcgacagcgtgggcaacctcaccggcgtcaagcgcctgcgcgactggacgggcgcgaccctgggcaatttcgccagcggcagcggccccgtcgtcaccaccaccttcgatgcggccaggctcaacgtcgccagcgtcggccgtagcggcaaccgcaacggcagccagatcagcgagaccagcccgatcttctcccacgacgcgctggggcgcctcaccggcggggtggacgggcgctggtatccggtcgccttcgattacgacgtgctcgaccgcgtcacccgcgccaccgacgccacgggccagccgcgccgctacgcgttcgacgtcaacggcaaccgcatcggtacggagctgattgccggcggcagccgtatcgattcctcggtggccgccttcgacgtgcaggaccgcgtcgcccacgtcctcgatcacgccggcaaccgcgtggcctacgcctacgatgcggtgggcaaccgggtgagcgtggaaagccccgacggctacgccatcggcttcgactacgacctcgccggacggccctattcggcctacgacgaagacggcaaccgcgtcttctccgccttcgacgtggccgggcgcgtgcgagcggtcatcgaccccaacggcgccgcgacgctctacgactatcacggcgacgagcaggacgggcgtctcgcgcgcgtggagcagcccgccatcccgggccagaacgcgggccgcgccgccgagaccgactacgatgcgggtgggttgcccatccgcgtgcgccaggtctcggccggcggcgaagcgcgcgaaggctaccgtttccacgacgagcttggccgcgtggtgcgcagcgtctccgcgccggacgacgtcggccagcggctgcaggtctgctacagctacgatgcactctcgaacctcacccaggtgcgcgccggcgccaccaccgacaccaccagtgccgcctgcgccggcagccccgcggtgcagctcacccagagctgggacgactttggcaacctgctgacgcgcaccgacgcgctgggccgggtgtggaagttcgagtacgacgcccacggcaacctcgtcgccagccagacgcccgagcaggccaaggtctcgacgcgcagcacctaccgctacgatccggcgctgcacggcttgctggccgggcgcagcgtgccgggcagcggcagtgcgggccagagcgtgagctatgcgcgcaacgcgctcggccaggtcatccgcgccgagacgcgcgacggcgcgggcaacctcgtcgtcgcctacgactaccagtacgacgccgcccaccgtgtggtgcgcatcgtcgacagccgcggcggcaaggcgctcgactacgcctggacgcccgccgggcggctggcgagcattaccctggacggccatgtctggcgcttccagtacgacggcgtcggccggctcgccgcgatcgtcgcgcccaacggcgccaccatagcgatggcacgcgatgccgccgggcggctcaccgagcggcgctggcccgacggcgcgaagagcgccttcgactggctgcccgaaggcagcctcgccgccatcgagcacagcgcgggcggcagcgcgctcgcacagttcgcctatgcctacgatgcctggggcaaccgcacgagcgccaccgagaccctcgcgggcaccagccgcagcctcgcctacggctacgacgcgctcgaccgcctgaagaccgtcaccaccgacggtgcgaccgaaacccatgccttcgatctcttcggcaatcgcaccagcaagaccacgggcggggtgaccaccgactatctcttcgacgcggcgcaccagctcacccaggtgcagatcgccggcacccccaccgagcggctcgcctacgacgacaacggtaatctccgcaagcactgcgtcggcagtccgagtggcagcaccagcgattgcaccggcaccaccgtgctgagcctcgcctggaacggcctcgaccagttgatccaggccgccaggacgggcctgcccgccgagtcctacgcctacgacgatgccgggcggcgtgtcaccaaggcggtgggcagcagcgccacccacttcgcctacgacggtcccgacatcctggccgagtacgccagcccggccggcagccccaccgccgtctatgcccacggtgccggcatcgacgaaccgctgctgcgcctcaccggcgcgacgagcacgccggccgcttccgcgcaccactacgcgcaggacgggctgggcagcatcgtcgcggcctatggcgagatcggcgccagcggtccggtcagtgccgcgagcgtatcggccacccacagttacagcgccggcagctacccgccggcaaagctgatcgacggcgagacgaccggaagcaccgggttctgggctggcagctcgggcaacttcgctgccgatccagccgtgatcacgctggaactgggtgcggagaaaagcgtgagccgcgtgaggctgcaccgggtggccagctacctgcccgactacgtggtcaaggatgccgaggtgcaggtccgaaaaccggacaattcgtggcagacggtcggcacgctgacaaacaacaccagcgaagacagtcccgagatcgtgctcaccggcgcccccggcagcgcgctgcgcgtgctcgtcaagggcgtgcgcaacggcagcctggtgctgatggccgaggtgacgatgagtgcggacggtggcgcggccagcgtggccaccgcccgctacgacgcctggggcaacgtcacgcaggcgagcggcagcatcccggccttcggctacaccggacgcgagcccgatgccacgggcctggtctactaccgcgcccgctactaccaccccgcgctcggccgcttcgccagccgcgacccgctggggctggcggcggggatcaatccctacgcctacgcgggcggcaatcccatcctctacaacgatccggatggcttgctggcgcaactggcgtggaatacggcggccagctactggggacagccgatagttcaagaaacggtcgccacgattcgaaatggggccgcagtggccgctggcaacttcgttccagacacggtcaacggtgcaacaggttggtttgagcagttcctgcaccaagaatcgggctcgttcgggcgcatggactcgtgggtggatgtgcgaaaccccgttgcgcaggacgtagcccaggacctgcgcggtgtcgcagccgttgggttaatgatgacgccgctgcggtatggtcgtgcctccaacgcgtctttcaatccgccagtagccaatcttccgctcaacactggaggaaaaacatctggcatgttgcacattccagggcaagaatcactgtcgctcacgagcggaattgcggggccgtctcaagtcgttagaggtcaaggtttgccaggattcaacggtaatcagttgacccatgtggaaggtcatgctgctgcttacatgcggactcacaaggtctctgaggctgttctggacataaacaaagcaccttgcaccgctggtagtggtggtggatgtaatgggttgcttccccgaatgctgccggagggggctcatttaacaattcgacacccaaatggtgttcaagtttatattggcactcctgactaa

SEQ ID NO: 144 - protein, 2227 aa, Chondromyces crocatus
MSMSASRSQPAFPFVSASSPRPRRRPPFPRALLLLIAVLLVGACGDAGGPLLWSSSSQALWEPSPIPPLPPLLCLGPGDGPSPFPPDLTQGTTTAAGTLPGSFSVTSTGEATYTIPVPTLPGRAGIEPSLAITYDSAQGEGLLGIGFHLQGLSSVDRCPRNVAQDGHIAPVRDAEDDALCLDGQRLVPVDPQPGRAPREYRTFPDSFTRVEADFAESEGWPAERGPKRLRAHGKAGLIYEYGGESSGRVLAQGEAVRSWLLTRLSDRDGNTMAVVYRNDLHAKGYTVEHAPQRITYTRHPTVPASRMVEFTYGPLEAADVRVHYARGMELRRSLSLRSIQMFGPGHVLARELRFGYGHGPATGRLRLEAVRECAGDGTCKPPTRFTWHTAGAAGYTQQQTLVEVPLSERGTLMTMDVSGDGLDDLVTSDMVVEAGTEEPITRWSVALNRSQELTPGFFEAAVTGQEQPHFIDAEPPYQPELGTPLDYDHDGRMDLFLHDVHGQSMTWEVLLSNGDGRFTRRDTGVPRPFTMGMTPAGLRSPDASTHLVDVDGDGMVDLLQCYLSAHEQLWYLHRWTAAAGGFAPHGDRVHALSSYPCHAELHAVDVDADGRVDLVMQELILVGSQVRAGWQYVAFSYELSDGSWTRALTGLRLTPPGDRVFFLDVNGDGLPDAVQSSRDDEQLYTSMNIGAGFAAPVPSLATPTLGAARFVRFASVLDHNADGRQDLLLAMSDGGSESLPAWKVLQATGEVGPGTFEIVHPGLPMGIVLQQDELPTPDHPLTPRVTDVNGDGAQDLLYAFNNQVHVFENVLGQEDLLAAVTDGMNAHAPEDAEYLPNVQIRYDHLIDRARTTEGFEDAPGIPSPEQRTYRPLEQSDEEPCRYPVRCVVGHRRVVSGYVLNNGADRPRTFQVAYRNGRHHRLGRGFLGFGTRIVRDLDTGAGTAEFYDNVTFDGAFQAFPFRGQVQRSWRWSPSLPLDAHSAEPASLELLTTRSYAVVIPTQAGTYFTLSLLEGKSRHQGTFSPGSGKTLEEAVRALEGDLASRMSDTLRTVSDFDLYGNILAEQTQTEGVDLDLSVTRSFDNDPLSWRLGELTRETTCSKAGGETQCRVMHRSYDGRGHVRLERVGGEPFDPEMQLDVWFSRDALGNIHSTRSRDGTGQVRASCTSYDALGLMPYAHRNLEGHQSYTRYDPAVGVLRASVDPNGLVSRWAYDGFGRVTLESLPGRMPTVIRRTWTKDGGAAGNAWNLKIRTASVGGQDETVQLDGLGREVRWWWQALDVGEEQAPRMMQEVAFDARGEHLAWRSLPIVDPAPPGSVQVRETWQYDGMGRVLRHVTPWGAATTHEYIGRDEVITAPGQAVTRIASDPLGRPTAVGDPEGGVSRYTYGPFGGLREVTTPAGAVTLTERDAFGRVRRQVSPDRGVSTAHYDGYGQKISSLDAAGRAVTTRYDTLGRIFRQVDEDGVTEFRWDDAQHGVGQLALVVSPDGHRLRYGFDHLGRPATTTLEIGGESFTSRLSYDLSGRLERIEYPSAPGIGSFAIEREYDPHGRLRALKDAGSGAEFWRATAIDAGNRITGERFGGGTATTLRTFDAARERVSRIETQTAGGPVQQLSYLWNDRRKLVERSDGLHANVERFRYDLLDRLTCAQFGLINAALCERPFTYGPDGNLLQKPGVGAYEYDPAQPHAVVRAGSAFYGYDAVGNQTSRPGATIAYTAFDLPKRIALTSGDTVDFAYDGLQQRVRKTTATQEIASFGEVYERVTDVVTGAVEHRYHVRNDERVVTLVRRSVAQGTRTLHVHVDHLGSIDVLTDGVTGSVAERRSYDAFGAPRHPDWGSGQPPSPHELSSLGFTGHEADLDLGLVNMKGRIYDPKLGRFLTPDPLVPRPLFGQSWNSYSYVLNSPLSLVDPSGFQEQPPATEDGCSQGCTIWVFGPPREPKPPAPPKVVEGNLEDAAGTGSTQAPVDVGTSGVRSGWSPQLPATLQTLGRGDAIARRIMDGVRIGMARMLLESAKLGILGGTSRVYVAYTNLTAAWNGYKESGLPGALDAVNPASQMVQAGVEAYEAAAAEDWEAAGASLFKAGSIGMSILATAVGVGGAITATVGSTAGAAGRAAARAPSLPAYAGGKTSGVLRTTAGDTALLSGYKGPSASMPRGTPGMNGRIKSHVEAHAAAVMREQGMKEGTLYINRVPCSGATGCDAMLPRMLPPDAHLRVVGPNGYDQVFVGLPD

SEQ ID NO: 145 - DNA, 6684 bp, Chondromyces crocatus
atgtccatgtcggcctcacggagtcagcccgcattccccttcgtgtcggcctcctctccgcgtccgcgccggcgccctccctttccccgagcgctgctcctcctcatcgccgtgctcctcgtcggcgcatgcggcgacgctggcggcccgcttctctggtcgagcagctcccaggccctctgggaaccctccccgatcccgccgctccccccgctcctgtgcctcggccccggcgacggtccctccccctttccgcctgaccttacgcaggggaccaccaccgcggcggggaccctgccagggagcttttcggtcacgagcacgggcgaggcgacgtacacgatcccggtccccacgctgcctggccgtgccggcatcgagccctcgctggcgatcacctacgacagtgcgcagggtgaagggctgctcgggatcggcttccacttgcagggcctctcgtcggtcgatcgctgcccccggaacgtcgcgcaggatggtcacatcgcgccggtccgggatgccgaggacgacgccttgtgcctcgatgggcagcggctcgtccccgtggacccgcagccagggcgtgcgccgcgggaataccgcacgttcccggacagcttcacgcgcgtcgaggccgacttcgcggagagcgaggggtggccggcggagcgtgggccgaagcggctgcgggcgcatggcaaagcggggctgatctacgaatacggtggagaatcatcgggccgggtgctcgcgcaaggggaggcggtgcggtcctggttgctgacgcggctcagcgaccgggatggcaacacgatggcggtggtctaccggaatgacctccacgcgaagggctacaccgtcgagcacgcgccgcagcggatcacctacaccaggcacccgactgtgccggcctcgcgcatggtggagttcacgtacgggccgctggaggcggcggacgtgcgcgtacactatgcccgcgggatggagctgcgccgctcgctgagcttgcgctcgatccagatgttcgggccgggacacgtgctcgcgagggagctgcgcttcggttacgggcatgggccggcgacgggtcgcttgcgactggaggcggttcgggagtgcgcaggtgacgggacgtgcaagccgccgacacgcttcacctggcacacggccggagcggctggatacacgcagcagcagacactggtggaggtgccgctgtcggagcgcggcacgttgatgacgatggacgtcagcggcgatggcctcgacgacctggtgacgtccgacatggtggtggaggccggcacggaagagccgatcacccgctggtcggtcgcgctcaaccggagccaggagctgacgccggggttcttcgaggcggccgtcactgggcaggagcagccgcatttcatcgacgcagagccgccgtaccagccggagctggggacgccgctcgactacgaccacgatggccggatggacctgtttctgcacgatgtgcacgggcagtcgatgacgtgggaggtgctgctgtcgaatggagatgggcggttcacgcggcgggatacgggggtgccgcggccgttcacgatgggcatgacgccggcgggattgcgcagcccggatgcgtcgacccatctggtggatgttgacggtgacgggatggtggacctgctgcagtgctacctgagcgcgcacgagcagctctggtacttgcaccgctggacggcagcggcggggggcttcgcgccgcacggcgatcgggtgcatgcgctgagctcctacccgtgccacgccgagctgcacgcggtcgatgtcgacgcggatgggcgggtggacctggtgatgcaggagctgatcctcgtcgggagccaggtgcgggcggggtggcagtacgtggcgttctcgtacgagctgtccgatggatcgtggacgcgcgcgctgacggggctgcggctcacgccgcctggggaccgggtgttcttcctcgacgtcaacggcgatgggctgcccgatgcggtgcagagcagccgggacgatgagcagctgtacacgtcgatgaatatcggcgcgggattcgcggcgccggtaccgagcctggcgacgccgacgctcggggctgcgaggttcgttcggtttgcgtcggtgctcgatcacaacgcggatgggcgacaagacctgctgctggccatgagcgatgggggatcggagtcgctgcccgcgtggaaggtgctccaggcgacgggggaggtcggtccggggacgttcgagatcgtccatcccgggctgccgatgggcatcgtgctccagcaggacgagctgcccacgcccgaccatccgctcacgccgcgggtcactgacgtgaatggggatggggcgcaggatctgctctatgcgttcaacaaccaggtccatgtgttcgagaacgtgctcggccaggaggacctgctcgcggccgtgaccgacggcatgaatgcgcacgctccggaggacgccgagtacctgcccaacgtgcagatccggtacgaccacctgatcgatcgtgcgcggacgacggagggcttcgaggatgctccagggatcccgtcacccgagcagcgcacctaccggcctctggagcaaagcgatgaggagccctgccgctatccggtgcggtgcgtggtcgggcatcggcgggtggtgagcggctatgtgctcaacaatggcgcggatcggccgcgcaccttccaggtggcctaccgcaatggccgtcaccatcgcctgggccgagggtttctggggttcgggacgcggatcgtgcgtgacctcgataccggcgcggggacggccgagttctacgacaacgtcacgtttgatggcgccttccaggccttccctttccgagggcaggtacagcgctcgtggcgctggagtccgagcttgccgctggacgcgcatagcgcggagccggcgtccctcgagctgctgacgacgcggagctacgcggtggtgatccccacgcaagcggggacgtacttcaccctctcgctgctggagggcaagagccgtcatcagggcacgttctcaccggggagtgggaaaacgctcgaagaagccgtgcgcgctctggaaggagatctcgcctcgcgaatgagcgacacgctccgcaccgtcagcgacttcgacctctacgggaacatcctcgccgagcaaacgcagacggagggcgtcgacctcgacctctcggtgacgcgcagcttcgacaacgacccgctctcctggcgccttggcgagctgacgcgagagacgacgtgcagcaaagcgggcggtgagacgcagtgccgggtgatgcaccggagctatgacgggcgcggccacgttcgcctggagcgcgtcgggggagagcccttcgacccggagatgcagctcgatgtctggttctcgcgggacgcgctgggcaacatccacagcacccggtcacgtgatgggacggggcaggtgcgcgcgagctgcaccagctacgacgcgctgggcttgatgccttatgcccaccgcaacctggagggccaccagagctatacgcgctacgacccggccgtgggcgtgctgcgggcgtcggtggatcccaacggcctggtgagccgctgggcctacgatggcttcgggcgggtgacgctggagagcctccccgggcgcatgcccaccgtcatccggcggacctggacgaaggacggcggagcggctggcaacgcctggaacctgaagatccgcaccgcctcggtggggggccaggacgagaccgtgcagctcgatggtctcgggcgggaggtgcgctggtggtggcaagcgctcgacgtgggggaagagcaagcgccgcggatgatgcaggaggtcgccttcgatgcgcggggcgagcacctcgcgtggcgctcgctgccgatcgtggatcccgcgccaccaggctcggtgcaggtgcgagagacgtggcaatacgacgggatggggcgggtgctccggcacgtcacgccgtggggggcggcgacgacgcacgagtacatcgggcgggacgaggtcatcaccgcgcctgggcaggccgtcacccgaatcgccagcgatccgctcgggaggcccacggcagtgggtgatcccgaaggtggcgtcagccggtacacctacggtcccttcggggggctgcgcgaggtgaccacgcccgctggtgccgtgacgctgaccgagcgggatgcgtttggccgcgtgcgacggcaggtgagcccggaccggggagtctctactgcgcactacgacggttacgggcagaagatctcatcgctcgacgcggcaggacgcgcggtcacgacccgctacgacacgctgggtcggattttcaggcaggtcgacgaagacggcgtcaccgagttccgttgggatgacgcgcagcatggagtgggtcagctcgcgctggtggtcagccccgatgggcatcggctgcgctacggcttcgaccacctcgggcgaccagcgacgacgacgctggagatcggaggggaaagcttcaccagccggctgtcttatgatctgagcggccggctcgagcggatcgagtacccgagcgcgccggggattggcagcttcgccatcgagcgggagtacgatcctcacgggcggctgcgggcgctgaaggatgcggggtcgggggcggagttctggcgagccaccgcgatcgatgcggggaatcgcatcacgggggagcgcttcggtggggggaccgccaccacgctccgcacgttcgacgcggcacgggagcgggtgagtcggatcgagacgcagacggcaggtgggcccgtccagcagctctcctacctctggaacgatcgccgcaagctcgtcgagcgctccgatggcctccacgccaacgtcgagcgctttcgttacgacctgctggaccggctgacgtgcgcgcagttcgggctgatcaatgctgccctctgcgagcgaccgttcacctacggacccgacggcaacctgctccagaagcccggcgtcggtgcctacgagtacgaccccgcgcagccccacgccgtcgtccgagctggtagcgcgttctacggctacgacgccgtcggcaaccagacctcacgacccggcgcgaccatcgcctacaccgcgttcgacctaccgaagcgaatcgcgctcaccagcggcgacaccgtcgacttcgcgtacgacggcctccagcagcgggtgcgcaagaccacggcgacgcaggagatcgcctccttcggcgaggtgtacgagcgcgtgaccgatgtcgtcacgggagccgtcgagcatcgctaccacgtgcgcaacgacgagcgcgtcgtcacgctggtgcggcgctcggtcgcgcaaggcacgcgcacgctgcatgtccatgtcgaccacctcgggtcgatcgatgtgctcaccgacggtgtgaccggcagcgtcgccgagcgccgcagctacgatgccttcggcgcaccgcgccatcccgactggggttcgggtcagcctccgtcaccccacgagctgtcgtcgcttggcttcaccgggcacgaggccgacctcgacctcggcctcgtgaacatgaaggggcgcatctacgaccccaagctcggacggttcctcacgcccgatccgctcgtgccgcggcctctcttcgggcagagctggaatagctattcgtacgtgctaaacagcccgctgtcgctggtcgatcccagtgggtttcaagagcagccacctgcgacagaggacggatgctcgcagggctgcaccatctgggtgttcggtcctccccgcgagccgaagccacctgcgccgcccaaggtcgtcgagggcaacctggaggacgccgctggcactggttcgacccaggcgccggtcgatgtcgggacctccggggtccgtagcggatggagtccgcagctcccggccacgttgcagaccttgggccgtggtgacgccatcgccaggcgcatcatggacggcgtccgcatcgggatggccaggatgctgctggagtccgcaaagctcggcatcctgggcggcaccagccgcgtctacgtcgcctacaccaacctcaccgccgcctggaatggctacaaagagagcgggctccccggcgctctcgacgccgtcaatcccgccagccagatggtccaagccggcgtggaggcctacgaggctgccgccgcagaggactgggaggccgccggcgccagcttgttcaaggccgggtcgatcgggatgtcgatcctggcgacggctgttggcgtcgggggagcgatcactgcgacagtgggctcgacggcaggagcggcggggagggcagccgcaagagccccctcactccctgcatatgctggcggaaaaacgtcgggagtactacggaccaccgcaggcgatacagcactgctgagcggctacaaggggccgtccgcatcgatgcctcgaggaacgccaggcatgaacggacgcatcaagtcgcatgtagaagctcatgcggctgccgtgatgcgagagcaagggatgaaggaaggaaccctgtacatcaatcgagtcccctgctctggcgccaccggatgcgacgcgatgctcccaagaatgctcccaccagatgcacaccttcgcgtggtcggtccgaatggttacgatcaagtttttgtcgggctgcccgactga

SEQ ID NO: 146 - DNA, 15 bp, Artificial Sequence
  Synthetic
ctagcctagccgttt

SEQ ID NO: 147 - DNA, 18 bp, Artificial Sequence
  Synthetic
cttagcatactcctcaat

SEQ ID NO: 148 - DNA, 17 bp, Artificial Sequence
  Synthetic
gctagtaaccacgttct

SEQ ID NO: 149 - DNA, 15 bp, Artificial Sequence
  Synthetic
agcattagcaggaat

SEQ ID NO: 150 - DNA, 15 bp, Artificial Sequence
  Synthetic
caaaaccatacctct

SEQ ID NO: 151 - DNA, 15 bp, Artificial Sequence
  Synthetic
cagttcttcaaatat

SEQ ID NO: 152 - DNA, 16 bp, Artificial Sequence
  Synthetic
attaaacacaaactat

SEQ ID NO: 153 - DNA, 18 bp, Artificial Sequence
  Synthetic
gagtttgatgctcaccct

SEQ ID NO: 154 - DNA, 15 bp, Artificial Sequence
  Synthetic
agaactgctattatt

SEQ ID NO: 155 - DNA, 17 bp, Artificial Sequence
  Synthetic
cctgtaagtaggagagt

SEQ ID NO: 156 - DNA, 13 bp, Artificial Sequence
  Synthetic
ctttggagtagaa

SEQ ID NO: 157 - DNA, 16 bp, Artificial Sequence
  Synthetic
gctaggctgccaatgt

SEQ ID NO: 158 - DNA, 14 bp, Artificial Sequence
  Synthetic
aagattagtatggt

SEQ ID NO: 159 - DNA, 12 bp, Artificial Sequence
  Synthetic
atgggctttggt

SEQ ID NO: 160 - DNA, 36 bp, Artificial Sequence
  Synthetic
tcaagtactacatatgataggactcaacggtggggc

SEQ ID NO: 161 - DNA, 37 bp, Artificial Sequence
  Synthetic
tactgattgatctagaacaacctcctttcgtggggga

SEQ ID NO: 162 - DNA, 40 bp, Artificial Sequence
  Synthetic
tactgattgatctagattacaactcgctccatgtcagttg

SEQ ID NO: 163 - DNA, 50 bp, Artificial Sequence
  Synthetic
tcaagtactagagctcacgggaggaaagatgtacgcagacgatttcgacg

SEQ ID NO: 164 - DNA, 36 bp, Artificial Sequence
  Synthetic
tatcagaaacggatccataggactcaacggtggggc

SEQ ID NO: 165 - DNA, 39 bp, Artificial Sequence
  Synthetic
tatgttactagcggccgctcaacaacctcctttcgtggg

SEQ ID NO: 166 - DNA, 35 bp, Artificial Sequence
  Synthetic
tcaagtactacatatgtacgcagacgatttcgacg

SEQ ID NO: 167 - DNA, 40 bp, Artificial Sequence
  Synthetic
tatgttactaagatctttacaactcgctccatgtcagttg

SEQ ID NO: 168 - DNA, 31 bp, Artificial Sequence
  Synthetic
cggactgaccggcaacgtgcccggcgtttgc

SEQ ID NO: 169 - DNA, 33 bp, Artificial Sequence
  Synthetic
ggcacgttgccggtcagtccgccttatttatgc

SEQ ID NO: 170 - DNA, 54 bp, Artificial Sequence
  Synthetic
tgttaagctaaagctttagggataacagggtaatctgctggatccggatttccg

SEQ ID NO: 171 - DNA, 46 bp, Artificial Sequence
  Synthetic
ttcagcatgcttgcggctcgagttgatgcgttgcataggacgttca

SEQ ID NO: 172 - DNA, 44 bp, Artificial Sequence
  Synthetic
aactcgagccgcaagcatgctgaaagggcgcaatgacgcaaacc

SEQ ID NO: 173 - DNA, 36 bp, Artificial Sequence
  Synthetic
tcaatcagtatctagagtagaacggatcgaccggca

SEQ ID NO: 174 - DNA, 55 bp, Artificial Sequence
  Synthetic
tgttaagctaaagctttagggataacagggtaatcgctcattgtccgtttgcagc

SEQ ID NO: 175 - DNA, 47 bp, Artificial Sequence
  Synthetic
ttcagcatgcttgcggctcgagttgcgaacgatcatgtgtgatacac

SEQ ID NO: 176 - DNA, 44 bp, Artificial Sequence
  Synthetic
aactcgagccgcaagcatgctgaatttcgagacccgcgatgacg

SEQ ID NO: 177 - DNA, 36 bp, Artificial Sequence
  Synthetic
tcaatcagtatctagacgagccgctcgatacgattg

SEQ ID NO: 178 - DNA, 57 bp, Artificial Sequence
  Synthetic
tgttaagctaaagctttagggataacagggtaatgtggtacttcaacgaagcagatg

SEQ ID NO: 179 - DNA, 44 bp, Artificial Sequence
  Synthetic
ttcagcatgcttgcggctcgagttatcggatcagtgactcgtgc

SEQ ID NO: 180 - DNA, 46 bp, Artificial Sequence
  Synthetic
aactcgagccgcaagcatgctgaaagcgagttgtaagaaacggagc

SEQ ID NO: 181 - DNA, 38 bp, Artificial Sequence
  Synthetic
tcaatcagtatctagaagtgagctctccgaaatcgaac

SEQ ID NO: 182 - DNA, 79 bp, Artificial Sequence
  Synthetic
taaaacgacggccagtgccaagcttagggataacagggtaatagcagctacgtgtacagtccggacgcaccgtattcgc

SEQ ID NO: 183 - DNA, 46 bp, Artificial Sequence
  Synthetic
aataaggcggactgaccggcaacgtgcccggcgtttgcgtagttgg

SEQ ID NO: 184 - DNA, 38 bp, Artificial Sequence
  Synthetic
ccgggcacgttgccggtcagtccgccttatttatgcgc

SEQ ID NO: 185 - DNA, 52 bp, Artificial Sequence
  Synthetic
gctcggtacccggggatcctctagactcgctccatgtcagttgctcgggccg

SEQ ID NO: 186 - DNA, 44 bp, Artificial Sequence
  Synthetic
tgaaattcagcaggatcacatatgcatccacgttttcaaaccgc

SEQ ID NO: 187 - DNA, 43 bp, Artificial Sequence
  Synthetic
tgcatgcctgcaggtcgactctagaagcgagaagcactcggtc

SEQ ID NO: 188 - DNA, 58 bp, Artificial Sequence
  Synthetic
aatgatacggcgaccaccgagatctacactctttccctacacgacgctcttccgatct

SEQ ID NO: 189 - DNA, 48 bp, Artificial Sequence
  Synthetic
tgcatgcctgcaggtcgactctagacttaaaaatacgtatcgctttag

SEQ ID NO: 190 - DNA, 54 bp, Artificial Sequence
  Synthetic
tgaaattcagcaggatcacatatggacccaccaacttttacttttaattttaac

SEQ ID NO: 191 - DNA, 44 bp, Artificial Sequence
  Synthetic
tgcctgcaggtcgactctagagttttcctggttttgtaagattg

SEQ ID NO: 192 - DNA, 73 bp, Artificial Sequence
  Synthetic
tagaaagaagcagttaagctaggcggattgaagattcgcaggagagcgagatggtgtaggctggagctgcttc

SEQ ID NO: 193 - DNA, 73 bp, Artificial Sequence
  Synthetic
tgataaatcagccgggtggcaactctgccatccggcatttccccgcaaatttacatatgaatatcctccttag

SEQ ID NO: 194 - DNA, 42 bp, Artificial Sequence
  Synthetic
tagtacagagaattcatggctaacgaattaacctggcatgac

SEQ ID NO: 195 - DNA, 42 bp, Artificial Sequence
  Synthetic
tcaatcagtatctagattactcactctctgccggtaatactg

SEQ ID NO: 196 - DNA, 36 bp, Artificial Sequence
  Synthetic
aaaaaaaaaaaaaaactcgccaaaaaaaaaaaaaaa

SEQ ID NO: 197 - DNA, 35 bp, Artificial Sequence
  Synthetic
aaaaaaaaaaaaaaagacggaaaaaaaaaaaaaaa

SEQ ID NO: 198 - DNA, 35 bp, Artificial Sequence
  Synthetic
aaaaaaaaaaaaaaagtcggaaaaaaaaaaaaaaa

SEQ ID NO: 199 - DNA, 35 bp, Artificial Sequence
  Synthetic
aaaaaaaaaaaaaaaggcggaaaaaaaaaaaaaaa

SEQ ID NO: 200 - DNA, 35 bp, Artificial Sequence
  Synthetic
aaaaaaaaaaaaaaagccggaaaaaaaaaaaaaaa

SEQ ID NO: 201 - DNA, 22 bp, Artificial Sequence
  Synthetic
ggtgtttcgtcctttccacaag

SEQ ID NO: 202 - DNA, 59 bp, Artificial Sequence
  Synthetic
gtctgtgcccctccctccctggcgttttagtactctgtaatgaaaattacagaatctac

SEQ ID NO: 203 - DNA, 59 bp, Artificial Sequence
  Synthetic
gcccctccctccctggcccaggtgttttagtactctgtaatgaaaattacagaatctac

SEQ ID NO: 204 - DNA, 59 bp, Artificial Sequence
  Synthetic
gccctccctggcccaggtgaagggttttagtactctgtaatgaaaattacagaatctac

SEQ ID NO: 205 - DNA, 58 bp, Artificial Sequence
  Synthetic
gtgtggttccagaaccggaggagttttagtactctgtaatgaaaattacagaatctac

SEQ ID NO: 206 - DNA, 55 bp, Artificial Sequence
  Synthetic
gaggcccccagagcagccacgttttagagctagaaatagcaagttaaaataaggc

SEQ ID NO: 207 - DNA, 56 bp, Artificial Sequence
  Synthetic
gccactggggcctcaacactcgttttagagctagaaatagcaagttaaaataaggc

SEQ ID NO: 208 - DNA, 55 bp, Artificial Sequence
  Synthetic
gagtccgagcagaagaagaagttttagagctagaaatagcaagttaaaataaggc

SEQ ID NO: 209 - DNA, 58 bp, Artificial Sequence
  Synthetic
  misc_feature (34)..(37): n is a, c, g, or t
acactctttccctacacgacgctcttccgatctnnnncaagtgtgatcacttgggtgg

SEQ ID NO: 210 - DNA, 49 bp, Artificial Sequence
  Synthetic
tggagttcagacgtgtgctcttccgatctggattcccgagtagcagatg

SEQ ID NO: 211 - DNA, 57 bp, Artificial Sequence
  Synthetic
  misc_feature (34)..(37): n is a, c, g, or t
acactctttccctacacgacgctcttccgatctnnnnggcccctaaccctatgtagc

SEQ ID NO: 212 - DNA, 48 bp, Artificial Sequence
  Synthetic
tggagttcagacgtgtgctcttccgatctcttctgctcggactcaggc

SEQ ID NO: 213 - DNA, 60 bp, Artificial Sequence
  Synthetic
  misc_feature (34)..(37): n is a, c, g, or t
acactctttccctacacgacgctcttccgatctnnnnctcaccatcgctcttctactatg

SEQ ID NO: 214 - DNA, 51 bp, Artificial Sequence
  Synthetic
tggagttcagacgtgtgctcttccgatctggctagggtgacttcatatgag

SEQ ID NO: 215 - DNA, 56 bp, Artificial Sequence
  Synthetic
  misc_feature (34)..(37): n is a, c, g, or t
acactctttccctacacgacgctcttccgatctnnnncgtaagccttctcctcact

SEQ ID NO: 216 - DNA, 52 bp, Artificial Sequence
  Synthetic
tggagttcagacgtgtgctcttccgatctgttgagtagtaggaatgcggtag

SEQ ID NO: 217 - DNA, 64 bp, Artificial Sequence
  Synthetic
  misc_feature (34)..(37): n is a, c, g, or t
acactctttccctacacgacgctcttccgatctnnnngacttcaaactctactcccactaatag

SEQ ID NO: 218 - DNA, 53 bp, Artificial Sequence
  Synthetic
tggagttcagacgtgtgctcttccgatctgttgtggtaaatatgtagagggag

SEQ ID NO: 219 - DNA, 56 bp, Artificial Sequence
  Synthetic
  misc_feature (34)..(37): n is a, c, g, or t
acactctttccctacacgacgctcttccgatctnnnncgggtccatcatccacaac

SEQ ID NO: 220 - DNA, 52 bp, Artificial Sequence
  Synthetic
tggagttcagacgtgtgctcttccgatctagagtaatagatagggctcaggc

SEQ ID NO: 221 - DNA, 60 bp, Artificial Sequence
  Synthetic
  misc_feature (34)..(37): n is a, c, g, or t
acactctttccctacacgacgctcttccgatctnnnnctgtagcattgttcgttacatgg

SEQ ID NO: 222 - DNA, 55 bp, Artificial Sequence
  Synthetic
tggagttcagacgtgtgctcttccgatctctgatgagcaagaaggatataattcc

SEQ ID NO: 223 - DNA, 56 bp, Artificial Sequence
  Synthetic
  misc_feature (34)..(37): n is a, c, g, or t
acactctttccctacacgacgctcttccgatctnnnnctctttcacccacagcacc

SEQ ID NO: 224 - DNA, 49 bp, Artificial Sequence
  Synthetic
tggagttcagacgtgtgctcttccgatctgattgttagcggtgtggtcg

SEQ ID NO: 225 - DNA, 59 bp, Artificial Sequence
  Synthetic
  misc_feature (34)..(37): n is a, c, g, or t
acactctttccctacacgacgctcttccgatctnnnnctttacagtgaaatgccccaac

SEQ ID NO: 226 - DNA, 48 bp, Artificial Sequence
  Synthetic
tggagttcagacgtgtgctcttccgatctgggggcaatgaatgaagcg

SEQ ID NO: 227 - DNA, 63 bp, Artificial Sequence
  Synthetic
  misc_feature (34)..(37): n is a, c, g, or t
acactctttccctacacgacgctcttccgatctnnnngctaacatgactaacacccttaattc

SEQ ID NO: 228 - DNA, 49 bp, Artificial Sequence
  Synthetic
tggagttcagacgtgtgctcttccgatctgtaggagtagcgtggtaagg

SEQ ID NO: 229 - DNA, 59 bp, Artificial Sequence
  Synthetic
  misc_feature (34)..(37): n is a, c, g, or t
acactctttccctacacgacgctcttccgatctnnnncccccattattcctagaaccag

SEQ ID NO: 230 - DNA, 50 bp, Artificial Sequence
  Synthetic
tggagttcagacgtgtgctcttccgatctgctatagggtaaatacgggcc

SEQ ID NO: 231 - DNA, 62 bp, Artificial Sequence
  Synthetic
  misc_feature (34)..(37): n is a, c, g, or t
acactctttccctacacgacgctcttccgatctnnnngatcattctatttccccctctattg

SEQ ID NO: 232 - DNA, 48 bp, Artificial Sequence
  Synthetic
tggagttcagacgtgtgctcttccgatctcactgtgcccgctcataag

SEQ ID NO: 233 - DNA, 58 bp, Artificial Sequence
  Synthetic
  misc_feature (34)..(37): n is a, c, g, or t
acactctttccctacacgacgctcttccgatctnnnngaaaaatccaccccttacgag

SEQ ID NO: 234 - DNA, 58 bp, Artificial Sequence
  Synthetic
tggagttcagacgtgtgctcttccgatctcgttttgtttaaactatataccaattcgg

SEQ ID NO: 235 - DNA, 60 bp, Artificial Sequence
  Synthetic
  misc_feature (34)..(37): n is a, c, g, or t
acactctttccctacacgacgctcttccgatctnnnnccccacccttactaacattaacg

SEQ ID NO: 236 - DNA, 52 bp, Artificial Sequence
  Synthetic
tggagttcagacgtgtgctcttccgatctgtttgttggttaggtagttgagg

SEQ ID NO: 237 - DNA, 59 bp, Artificial Sequence
  Synthetic
  misc_feature (34)..(37): n is a, c, g, or t
acactctttccctacacgacgctcttccgatctnnnncctattcgcctacacaattctc

SEQ ID NO: 238 - DNA, 56 bp, Artificial Sequence
  Synthetic
tggagttcagacgtgtgctcttccgatctgttggtattaggattaggattgttgtg

SEQ ID NO: 239 - DNA, 57 bp, Artificial Sequence
  Synthetic
  misc_feature (34)..(37): n is a, c, g, or t
acactctttccctacacgacgctcttccgatctnnnnctcaaatgggcctgtccttg

SEQ ID NO: 240 - DNA, 55 bp, Artificial Sequence
  Synthetic
tggagttcagacgtgtgctcttccgatctgtactacaggtggtcaagtatttatg

SEQ ID NO: 241 - DNA, 62 bp, Artificial Sequence
  Synthetic
  misc_feature (34)..(37): n is a, c, g, or t
acactctttccctacacgacgctcttccgatctnnnnccatttaccgtacatagcacattac

SEQ ID NO: 242 - DNA, 53 bp, Artificial Sequence
  Synthetic
tggagttcagacgtgtgctcttccgatctcgtgagtggttaatagggtgatag

SEQ ID NO: 243 - DNA, 28 bp, Artificial Sequence
  Synthetic
gaacaagatattcgaaaaataggaggac

SEQ ID NO: 244 - DNA, 18 bp, Artificial Sequence
  Synthetic
gcggtttcgatgatgtgg

SEQ ID NO: 245 - DNA, 20 bp, Artificial Sequence
  Synthetic
cactcaccaagacctcaacc

SEQ ID NO: 246 - DNA, 28 bp, Artificial Sequence
  Synthetic
gaatgatggttgtctttggatatactac

SEQ ID NO: 247 - DNA, 25 bp, Artificial Sequence
  Synthetic
cttacactattcctcatcacccaac

SEQ ID NO: 248 - DNA, 24 bp, Artificial Sequence
  Synthetic
gttcattttggttctcagggtttg

SEQ ID NO: 249 - DNA, 17 bp, Artificial Sequence
  Synthetic
aggcaccagggcgtgat

SEQ ID NO: 250 - DNA, 17 bp, Artificial Sequence
  Synthetic
cagggtgaggatgcctc

SEQ ID NO: 251 - DNA, 19 bp, Artificial Sequence
  Synthetic
gcaaatcttaccccgcctg

SEQ ID NO: 252 - DNA, 20 bp, Artificial Sequence
  Synthetic
aattaggctgtgggtggttg

SEQ ID NO: 253 - DNA, 20 bp, Artificial Sequence
  Synthetic
gccatactagtctttgccgc

SEQ ID NO: 254 - DNA, 19 bp, Artificial Sequence
  Synthetic
ggcaggtcaatttcactgg

SEQ ID NO: 255 - DNA, 18 bp, Artificial Sequence
  Synthetic
gccattctcatccaaacc

SEQ ID NO: 256 - DNA, 19 bp, Artificial Sequence
  Synthetic
ggttgagggataggaggag

SEQ ID NO: 257 - DNA, 20 bp, Artificial Sequence
  Synthetic
caagctccatctgcctacga

SEQ ID NO: 258 - DNA, 20 bp, Artificial Sequence
  Synthetic
gcgattatgagaatgactgc

SEQ ID NO: 259 - DNA, 20 bp, Artificial Sequence
  Synthetic
attacacatgcaagcatccc

SEQ ID NO: 260 - DNA, 20 bp, Artificial Sequence
  Synthetic
cacgaaattgaccaaccctg

SEQ ID NO: 261 - DNA, 20 bp, Artificial Sequence
  Synthetic
tagcagagaccaaccgaacc

SEQ ID NO: 262 - DNA, 20 bp, Artificial Sequence
  Synthetic
atgaagaatagggcgaaggg

SEQ ID NO: 263 - DNA, 22 bp, Artificial Sequence
  Synthetic
ctatctcgcacctgaaacaagc

SEQ ID NO: 264 - DNA, 22 bp, Artificial Sequence
  Synthetic
ggtggagtagattaggcgtagg

SEQ ID NO: 265 - DNA, 18 bp, Artificial Sequence
  Synthetic
tgttagcggttaggcgta

SEQ ID NO: 266 - DNA, 18 bp, Artificial Sequence
  Synthetic
ttacaccaaccacccaac

SEQ ID NO: 267 - DNA, 18 bp, Artificial Sequence
  Synthetic
tttaccctcctacaagcc

SEQ ID NO: 268 - DNA, 18 bp, Artificial Sequence
  Synthetic
gcggatgaagcagatagt

SEQ ID NO: 269 - DNA, 20 bp, Artificial Sequence
  Synthetic
gcctgcctgatcctccaaat

SEQ ID NO: 270 - DNA, 21 bp, Artificial Sequence
  Synthetic
aaggtagcggatgattcagcc

SEQ ID NO: 271 - DNA, 21 bp, Artificial Sequence
  Synthetic
caggtactccaaagattcagg

SEQ ID NO: 272 - DNA, 21 bp, Artificial Sequence
  Synthetic
gtcaacttcaatgtcggatgg

SEQ ID NO: 273 - DNA, 50 bp, Artificial Sequence
  Synthetic
aatgatacggcgaccaccgagatctacactcgtcggcagcgtcagatgtg

SEQ ID NO: 274 - DNA, 53 bp, Artificial Sequence
  Synthetic
caagcagaagacggcatacgagattcgccttagtctcgtgggctcggagatgt

SEQ ID NO: 275 - DNA, 53 bp, Artificial Sequence
  Synthetic
caagcagaagacggcatacgagatctagtacggtctcgtgggctcggagatgt

SEQ ID NO: 276 - DNA, 53 bp, Artificial Sequence
  Synthetic
caagcagaagacggcatacgagatttctgcctgtctcgtgggctcggagatgt

SEQ ID NO: 277 - DNA, 53 bp, Artificial Sequence
  Synthetic
caagcagaagacggcatacgagatgctcaggagtctcgtgggctcggagatgt

SEQ ID NO: 278 - DNA, 53 bp, Artificial Sequence
  Synthetic
caagcagaagacggcatacgagataggagtccgtctcgtgggctcggagatgt

SEQ ID NO: 279 - DNA, 53 bp, Artificial Sequence
  Synthetic
caagcagaagacggcatacgagatcatgcctagtctcgtgggctcggagatgt

SEQ ID NO: 280 - DNA, 53 bp, Artificial Sequence
  Synthetic
caagcagaagacggcatacgagatgtagagaggtctcgtgggctcggagatgt

SEQ ID NO: 281 - DNA, 53 bp, Artificial Sequence
  Synthetic
caagcagaagacggcatacgagatcctctctggtctcgtgggctcggagatgt

SEQ ID NO: 282 - DNA, 53 bp, Artificial Sequence
  Synthetic
caagcagaagacggcatacgagatagcgtagcgtctcgtgggctcggagatgt

SEQ ID NO: 283 - DNA, 324 bp, Artificial Sequence
  Synthetic
ggcagctacgccctgggtccgtatcagattagcgccccgcagctgccagcttacaatggtcagaccgtgggtaccttctactatgtgaacgacgcgggcggtctggagagcaaggtgtttagcagcggcggtccaaccccgtacccaaactatgccaatgccggtcatgtggagggtcagagcgccctgttcatgcgtgataacggcatcagcgagggtctggtgttccacaacaacccggaaggcacctgcggtttttgcgtgaacatgaccgagaccctgctgccggaaaacgcgaaaatgaccgtggtgccgccggaaggt

SEQ ID NO: 284 - protein, 108 aa, Artificial Sequence
  Synthetic
GSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEG

SEQ ID NO: 285 - DNA, 90 bp, Artificial Sequence
  Synthetic
gccattccagtgaagcgcggcgctaccggtgaaaccaaagtgtttaccggtaacagcaacagcccgaagagcccgaccaaaggcggttgc

SEQ ID NO: 286 - protein, 30 aa, Artificial Sequence
  Synthetic
AIPVKRGATGETKVFTGNSNSPKSPTKGGC

SEQ ID NO: 287 - DNA, 3780 bp, Artificial Sequence
  Synthetic
ggcagctacgccctgggtccgtatcagattagcgccccgcagctgccagcttacaatggtcagaccgtgggtaccttctactatgtgaacgacgcgggcggtctggagagcaaggtgtttagcagcggcggttctggtggttcttctggtggttctagcggcagcgagactcccgggacctcagagtccgccacacccgaaagtagtggcggcagcagcggcggcagcgggaaacggaactacatcctggggcttgccattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcaagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataagaacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcacatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtc

SEQ ID NO: 288 - protein, 1260 aa, Artificial Sequence
  Synthetic
GSYALGPYQISAPQLPAYNGQTVGTFYYVNDAGGLESKVFSSGGSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGGSPKKKRKVSSDYKDHDGDYKDHDIDYKDDDDKSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 289 - DNA, 3930 bp, Artificial Sequence
  Synthetic
ccaaccccgtacccaaactatgccaatgccggtcatgtggagggtcagagcgccctgttcatgcgtgataacggcatcagcgagggtctggtgttccacaacaacccggaaggcacctgcggtttttgcgtgaacatgaccgagaccctgctgccggaaaacgcgaaaatgaccgtggtgccgccggaaggtgccattccagtgaagcgcggcgctaccggtgaaaccaaagtgtttaccggtaacagcaacagcccgaagagcccgaccaaaggcggttgctctggtggttcttctggtggttctagcggcagcgagactcccgggacctcagagtccgccacacccgaaagtagtggcggcagcagcggcggcagcgggaaacggaactacatcctggggcttgccattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcaagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataagaacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcacatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtc

SEQ ID NO: 290 - protein, 1310 aa, Artificial Sequence
  Synthetic
PTPYPNYANAGHVEGQSALFMRDNGISEGLVFHNNPEGTCGFCVNMTETLLPENAKMTVVPPEGAIPVKRGATGETKVFTGNSNSPKSPTKGGCSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGGSPKKKRKVSSDYKDHDGDYKDHDIDYKDDDDKSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 291 - DNA, 5004 bp, Artificial Sequence
  Synthetic
aaacggacagccgacggaagcgagttcgagtcaccaaagaagaagcggaaagtcggcagctacgccctgggtccgtatcagattagcgccccgcagctgccagcttacaatggtcagaccgtgggtaccttctactatgtgaacgacgcgggcggtctggagagcaaggtgtttagcagcggcggttctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 292 - protein, 1668 aa, Artificial Sequence
  Synthetic
KRTADGSEFESPKKKRKVGSYALGPYQISAPQLPAYNGQTVGTFYYVNDAGGLESKVFSSGGSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 293 - DNA, 5155 bp, Artificial Sequence
  Synthetic
aaacggacagccgacggaagcgagttcgagtcaccaaagaagaagcggaaagtcccaaccccgtacccaaactatgccaatgccggtcatgtggagggtcagagcgccctgttcatgcgtgataacggcatcagcgagggtctggtgttccacaacaacccggaaggcacctgcggtttttgcgtgaacatgaccgagaccctgctgccggaaaacgcgaaaatgaccgtggtgccgccggaaggtgccattccagtgaagcgcggcgctaccggtgaaaccaaagtgtttaccggtaacagcaacagcccgaagagcccgaccaaaggcggttgcttctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 294 - DNA, 2733 bp, Artificial Sequence
  Synthetic
cccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcaaacggagggggaaagcaagccctggaaaccgtgcaaaggttgttgccggtcctttgtcaagaccacggccttacaccggagcaagtcgtggccattgcatcccacgacggtggcaaacaggctcttgagacggttcagagacttctcccagttctctgtcaagcccacgggctgactcccgatcaagttgtagcgattgcgtcgaacattggagggaaacaagcattggagactgtccaacggctccttcccgtgttgtgtcaagcccacggtttgacgcctgcacaagtggtcgccatcgcctcgaatggcggcggtaagcaggcgctggaaacagtacagcgcctgctgcctgtactgtgccaggatcatggactgaccccagaccaggtagtcgcaatcgcgtcaaacggagggggaaagcaagccctggaaaccgtgcaaaggttgttgccggtcctttgtcaagaccacggccttacaccggagcaagtcgtggccattgcaagcaacatcggtggcaaacaggctcttgagacggttcagagacttctcccagttctctgtcaagcccacgggctgactcccgatcaagttgtagcgattgcgtcgcatgacggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactgaccccagaccaggtagtcgcaatcgcgtcacatgacgggggaaagcaagccctggaaaccgtgcaaaggttgttgccggtcctttgtcaagaccacggccttacaccggagcaagtcgtggccattgcatcccacgacggtggcaaacaggctcttgagacggttcagagacttctcccagttctctgtcaagcccacgggctgactcccgatcaagttgtagcgattgcgtccaacggtggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactgaccccagaccaggtagtcgcaatcgcgtcacatgacgggggaaagcaagccctggaaaccgtgcaaaggttgttgccggtcctttgtcaagaccacggccttacaccggagcaagtcgtggccattgcaagcaacatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgccagccatgatggcggtaagcaggcgctggaaacagtacagcgcctgctgcctgtactgtgccaggatcatggactgacacccgaacaggtggtcgccattgcttctaatgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatccggcagctacgccctgggtccgtatcagattagcgccccgcagctgccagcttacaatggtcagaccgtgggtaccttctactatgtgaacgacgcgggcggtctggagagcaaggtgtttagcagcggcggttctggcggctcaactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctg

SEQ ID NO: 295 - protein, 911 aa, Artificial Sequence
  Synthetic
PKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASNIGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSGSYALGPYQISAPQLPAYNGQTVGTFYYVNDAGGLESKVFSSGGSGGSTNLSDIIEKETGKQLVIQESILMLPEEVEEVIGNKPESDILVHTAYDESTDENVMLLTSDAPEYKPWALVIQDSNGENKIKML

SEQ ID NO: 296 - DNA, 2883 bp, Artificial Sequence
  Synthetic
cccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcacatgacgggggaaagcaagccctggaaaccgtgcaaaggttgttgccggtcctttgtcaagaccacggccttacaccggagcaagtcgtggccattgcaagcaatgggggtggcaaacaggctcttgagacggttcagagacttctcccagttctctgtcaagcccacgggctgactcccgatcaagttgtagcgattgcgtccaacggtggagggaaacaagcattggagactgtccaacggctccttcccgtgttgtgtcaagcccacggtttgacgcctgcacaagtggtcgccatcgccagccatgatggcggtaagcaggcgctggaaacagtacagcgcctgctgcctgtactgtgccaggatcatggactgaccccagaccaggtagtcgcaatcgcgtcacatgacgggggaaagcaagccctggaaaccgtgcaaaggttgttgccggtcctttgtcaagaccacggccttacaccggagcaagtcgtggccattgcaagcaacatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactgaccccagaccaggtagtcgcaatcgcgtcgaacattgggggaaagcaagccctggaaaccgtgcaaaggttgttgccggtcctttgtcaagaccacggccttacaccggagcaagtcgtggccattgcaagcaatgggggtggcaaacaggctcttgagacggttcagagacttctcccagttctctgtcaagcccacgggctgactcccgatcaagttgtagcgattgcgtccaacggtggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactgaccccagaccaggtagtcgcaatcgcgtcgaacattgggggaaagcaagccctggaaaccgtgcaaaggttgttgccggtcctttgtcaagaccacggccttacaccggagcaagtcgtggccattgcaagcaatgggggtggcaaacaggctcttgagacggttcagagacttctcccagttctctgtcaagcccacgggctgactcccgatcaagttgtagcgattgcgtcgaacattggagggaaacaagcattggagactgtccaacggctccttcccgtgttgtgtcaagcccacggtttgacgcctgcacaagtggtcgccatcgccagccatgatggcggtaagcaggcgctggaaacagtacagcgcctgctgcctgtactgtgccaggatcatggactgacacccgaacaggtggtcgccattgcttctaatgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatccccaaccccgtacccaaactatgccaatgccggtcatgtggagggtcagagcgccctgttcatgcgtgataacggcatcagcgagggtctggtgttccacaacaacccggaaggcacctgcggtttttgcgtgaacatgaccgagaccctgctgccggaaaacgcgaaaatgaccgtggtgccgccggaaggtgccattccagtgaagcgcggcgctaccggtgaaaccaaagtgtttaccggtaacagcaacagcccgaagagcccgaccaaaggcggttgctctggcggctcaactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctg

SEQ ID NO: 297 - protein, 961 aa, Artificial Sequence
  Synthetic
PKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASNIGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNIGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSPTPYPNYANAGHVEGQSALFMRDNGISEGLVFHNNPEGTCGFCVNMTETLLPENAKMTVVPPEGAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 298 - protein, 30 aa, Artificial Sequence; identical to SEQ ID NO: 13
  Synthetic

SEQ ID NO: 299 - protein, 29 aa, Artificial Sequence
  Synthetic
MSVLTPLLLRGLTGSARRLPVPRAKIHSL

SEQ ID NO: 300 - DNA, 214 bp, Artificial Sequence; identical to SEQ ID NO: 15
  Synthetic

SEQ ID NO: 301 - DNA, 214 bp, Artificial Sequence; identical to SEQ ID NO: 15
  Synthetic

SEQ ID NO: 302 - DNA, 2497 bp, Artificial Sequence
  Synthetic
atggccctgtcccgtgcggtttgtggcacctcccgtcaactggctccggttctgggttatctgggttcccgtcaaaaacactccctgccggactacccgtatgatgttccggattacgctggctacccatacgacgtcccagactacgctggctacccatacgacgtcccagactacgctatggacatcgcggatctgcgtaccctgggttacagccagcagcagcaggagaagatcaagccgaaggtgcgcagcaccgtggctcagcaccacgaagccctggtgggccacggtttcacccacgctcacattgtggccctgagccagcacccagccgcgctgggcaccgtggccgtgaaatatcaggatatgattgctgccctgccagaggccacccatgaagctattgtgggcgtgggcaagcagtggagcggtgctcgtgcgctggaggcgctgctgaccgtggctggtgaactgcgtggtccgccgctgcagctggacaccggtcagctgctgaaaatcgcgaaacgtggcggtgtgaccgcggtggaagccgtgcatgcttggcgtaatgctctgaccggtgcgccgctgaacctgaccccgcagcaggtggtggctattgccagcaacaacggcggtaaacaggccctggagaccgtgcagcgcctgctgccggtgctgtgccaggcccatggtctgaccccggagcaggtggtggcgatcgctagcaacatcggcggcaagcaggccctggaaaccgtgcaggcgctgttaccggtgctgtgccaggctcatggcctgaccccggaacaagttgtggctattgccagccatgatggcggtaaacaggctctggaaaccgtgcagcgtctgttgccggtgctgtgccaagcccatggcctgaccccggagcaagttgtggctattgcgagccatgatggcggcaagcaggcgctggaaaccgttcagcgcctgttaccggtgctgtgccaagctcatggtctgaccccggaacaggtggtggccattgcttcccatgatggcggtaaacaggccctggaaaccgttcagcgtctgcttccggtgctgtgccaggcccatgggctgaccccggaacaagtggttgctattgccagccacgatggcggcaagcaggctctggagaccgttcagcgcctgcttccggtgctgtgccaggcccatggcttaaccccggaacaagttgttgctattgctagtcatgatggcggtaaacaggcgctggagaccgttcagcgtctgttaccggtgctgtgccaggcgcatggcttaaccccggagcaggttgttgccattgcctccaatatcggcggcaagcaggctctggaaaccgttcaggccctgttgccggtgctgtgccaggcccatggactgaccccgcagcaagttgttgccattgccagcaatggcggtggcaaacaggcgctggaaactgttcagcgcctgctcccggtgctgtgccaagcgcatggtctgaccccgcagcaagtggttgctattgctagcaatggtggcggtcgtccggcgctggaaagcattgtggctcagctgagccgtccagacccggccctggcggctctgaccaacgatcacctggtggcgctggcttgcctgggcggtcgtccggccctggatgcggtgaagaaaggcctgggtggatccggcagctacgccctgggtccgtatcagattagcgccccgcagctgccagcttacaatggtcagaccgtgggtaccttctactatgtgaacgacgcgggcggtctggagagcaaggtgtttagcagcggcggtccaaccccgtacccaaactatgccaatgccggtcatgtggagggtcagagcgccctgttcatgcgtgataacggcatcagcgagggtctggtgttccacaacaacccggaaggcacctgcggtttttgcgtgaacatgaccgagaccctgctgccggaaaacgcgaaaatgaccgtggtgccgccggaaggttctggcggctcaactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgtgataaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 303 - DNA, 2281 bp, Artificial Sequence
  Synthetic
tccgttctgaccccgctgctgctgcgtggcctgaccggctccgctcgtcgtctgccagttccgcgtgcgaaaatccattccctggactacaaagaccatgacggtgattataaagatcatgacatcgattacaaggatgacgatgacaagatggacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagagaggagccggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccgcagcaggtggtggctattgccagcaacaacggcggtaaacaggctctggaaaccgtgcagcgcctgctgccggtgctgtgccaggctcatggtctgaccccggagcaggtggtggcgatcgctagcaacatcggcggcaagcaggctctggagaccgttcaggccctgttaccggtgctgtgccaagcccatggtctgaccccgcagcaagttgtggctattgccagcaatggcggtggcaaacaggcgctggagaccgtgcagcgtctgttgccggtgctgtgccaagcccatgggctgaccccgcagcaagtggttgccatcgccagcaacaacggtggcaagcaggccctggagaccgttcagcgcctgttaccggtgctgtgccaggcccatggcttaaccccgcagcaagttgtggccatcgctagcaacaacggtggcaaacaggctctggagactgttcagcgtctgcttccggtgctgtgccaagcgcatggcctgaccccggaacaagttgttgctattgccagccatgatggtggcaagcaggcgctggaaaccgttcagcgcctgcttccggtgctgtgccaggcgcatggattaaccccgcagcaagtggtggccatcgccagcaatggtggcggtaaacaggccctggaaaccgttcagcgtctgttaccggtgctgtgccaggcccatggattaaccccggaacaagttgtggctattgcgtccaatatcggcggcaagcaggcgctggaaactgtgcaggctctgctcccggtgctgtgccaggcccatgggttaaccccgcagcaggttgttgccattgcgagcaacggcggtggcaaacaggctctggagacggttcagcgcctgctcccggtgctgtgccaggcccatggtttaaccccgcagcaggtggttgctattgctagcaatggcggcggcaagcaggcgctggaaacggtgcagcgtctgctaccggtgctgtgccaggcacatggccttaccccgcagcaagttgtggccattgctagcaatggcggtggccgtccggccctggaaagcattgtggcgcagctgagccgtccagacccggccctggcggctctgaccaatgatcacctggtggccctggcctgcctgggtggccgtccggctctggatgccgtgaagaaaggtctgggcggatccgccattccagtgaagcgcggcgctaccggtgaaaccaaagtgtttaccggtaacagcaacagcccgaagagcccgaccaaaggcggttgctctggcggctcaactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgtgataaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaa

SEQ ID NO: 304 - DNA, 2331 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccggaacaggtggttgccatcgcatccaataatggtggtaaacaagctctggagaccgttcaagccctgctgccagtgctgtgccaggctcatggtctgaccccgcagcaagttgtggctattgccagcaacatcggcggcaagcaggccctggagaccgtgcagcgtctgctgccggtgctgtgccaggcccatggcctgaccccgcagcaagtggttgctatcgccagcaacaacggcggtaaacaggctctggaaaccgtgcagcgcctgttaccggtgctgtgccaagcccatggtctgaccccggagcaggtggtggcgattgctagcaacggcggtggcaagcaggctctggagaccgttcaggccctgcttccggtgctgtgccaagcgcatggcctgaccccggaacaagttgttgccattgccagcaatggtggcggtaaacaggcgctggaaaccgtgcaggctctgttaccggtgctgtgccaggcccatgggctgaccccggagcaagtggtggctattgcgagcaatggcggtggcaagcaggccctggaaaccgtgcaggcgctgttgccggtgctgtgccaagcccatggattaaccccggaacaagtggtggcgatcgctagcaacaacggtggcaaacaggcgctggagaccgttcagcgtctgttaccggtgctgtgccaggcgcatggcttaaccccggaacaggttgttgcgattgccagcaacattggtggcaagcaggctctggaaaccgttcaggccctgctcccggtgctgtgccaggcccatggtttaaccccggaacaggtggtggccattgccagcaacggtggcggtaaacaggccctggagaccgttcagcgcctgctaccggtgctgtgccaggcccatggactgaccccggagcaagttgttgccattgctagcaacaacggcggcaagcaggcgctggagaccgtgcaggctctgcttccggtgctgtgccaggcccatgggttaaccccggagcaggttgtggccatcgccagccacgacggcggtaaacaggccctggaaaccgttcaggcgctgctaccggtgctgtgccaggcacatggcttaaccccggagcaggtggttgccatcgcctccaatggcggtggcaagcaggctctggaaacggtgcaggccctgctgccggtgctgtgccaagcccatgggttgaccccggaacaagtggtggctattgctagccacgacggtggcaaacaggctctggagactgttcagcgtctgcttccggtgctgtgccaggctcatggcttaaccccgcagcaagttgttgctattgcctccaatattggtggcaagcaggcgctggaaaccgttcagcgcctgctgccggtgctgtgccaggctcatgggcttaccccggaacaagttgtggccattgcctcccatgatggtggcaaacaggcgctggaaactgtgcaggctctgctcccggtgctgtgccaggctcatggattaaccccgcagcaagtggtggccattgctagccacgatggtggcaagcaggccctggagacggttcagcgtctgctcccggtgctgtgccaggcccatgggctaaccccgcagcaggttgttgctattgccagtcatgatggtggcaaacaggctctggaaactgtgcagcgcctgctaccggtgctgtgccaggctcacggtctgaccccgcagcaggtggtggcaatcgcaagcaacggtggtggtcgtccggcactggaaagcattgtggcgcagctgagccgtccagacccggccctggcggctctgaccaatgatcacctggtggccctggcctgcctgggtggccgtccggctctggatgccgtgaagaaaggtctgggc

SEQ ID NO: 305 - protein, 777 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQALLPVLCQAHGLTPQQVVAIASNIGGKQALETVQRLLPVLCQAHGLTPQQVVAIASNNGGKQALETVQRLLPVLCQAHGLTPEQVVAIASNGGGKQALETVQALLPVLCQAHGLTPEQVVAIASNGGGKQALETVQALLPVLCQAHGLTPEQVVAIASNGGGKQALETVQALLPVLCQAHGLTPEQVVAIASNNGGKQALETVQRLLPVLCQAHGLTPEQVVAIASNIGGKQALETVQALLPVLCQAHGLTPEQVVAIASNGGGKQALETVQRLLPVLCQAHGLTPEQVVAIASNNGGKQALETVQALLPVLCQAHGLTPEQVVAIASHDGGKQALETVQALLPVLCQAHGLTPEQVVAIASNGGGKQALETVQALLPVLCQAHGLTPEQVVAIASHDGGKQALETVQRLLPVLCQAHGLTPQQVVAIASNIGGKQALETVQRLLPVLCQAHGLTPEQVVAIASHDGGKQALETVQALLPVLCQAHGLTPQQVVAIASHDGGKQALETVQRLLPVLCQAHGLTPQQVVAIASHDGGKQALETVQRLLPVLCQAHGLTPQQVVAIASNGGGRPALESIVAQLSRPDPALAALTNDHLVALACLGGRPALDAVKKGLG

SEQ ID NO: 306 - DNA, 2025 bp, Artificial Sequence
  Synthetic
gacatcgcggatctgcgtaccctgggttacagccagcagcagcaggagaagatcaagccgaaggtgcgcagcaccgtggctcagcaccacgaagccctggtgggccacggtttcacccacgctcacattgtggccctgagccagcacccagccgcgctgggcaccgtggccgtgaaatatcaggatatgattgctgccctgccagaggccacccatgaagctattgtgggcgtgggcaagcagtggagcggtgctcgtgcgctggaggcgctgctgaccgtggctggtgaactgcgtggtccgccgctgcagctggacaccggtcagctgctgaaaatcgcgaaacgtggcggtgtgaccgcggtggaagccgtgcatgcttggcgtaatgctctgaccggtgcgccgctgaacctgaccccggaacaagtggttgctatcgcatcccatgacggcggtaaacaagccctggagaccgttcaagccctgctgccagtgctgtgccaggctcatggtctgaccccgcagcaggtggtggctattgccagcaatggcggtggcaagcaggcgctggagaccgtgcagcgtctgctgccggtgctgtgccaagcccatggcctgaccccgcagcaagttgtggctatcgccagcaacattggtggcaaacaggccctggaaaccgtgcagcgcctgttaccggtgctgtgccaggcccatggtctgaccccggagcaggtggtggcgatcgctagcaacaacggtggcaagcaggctctggaaaccgtgcaggccctgcttccggtgctgtgccaggcccatgggctgaccccggaacaagttgtggctattgccagccacgacggtggcaaacaggcgctggaaaccgtgcaggctctgttaccggtgctgtgccaagcgcatggcctgaccccggaacaggtggtggctattgctagccacgatggtggcaagcaggccctggagaccgttcaggcgctgttgccggtgctgtgccaggcgcatggcttaaccccggaacaagttgttgcgattgctagcaacggtggcggtaaacaggctctggagaccgttcagcgtctgttaccggtgctgtgccaggcacatggcctgaccccggagcaagttgttgccattgccagcaacatcggcggcaagcaggctctggagaccgtgcaggccctgctcccggtgctgtgccaggcccatggcttaaccccggagcaagttgtggccattgccagcaacaacggcggtaaacaggcgctggagaccgttcagcgcctgctaccggtgctgtgccaggctcatggcttgaccccggaacaggttgttgcgattgcgagccatgatggcggcaagcaggcgctggaaaccgttcaggctctgcttccggtgctgtgccaggcccatggattaaccccggagcaggttgttgctattgccagccatgatggcggtaaacaggccctggagaccgtgcaggcgctgctaccggtgctgtgccaggctcatgggctgaccccggagcaagtggttgctatcgcgagcaacaatggcggcaagcaggctctggaaacggtgcaggccctgctgccggtgctgtgccaggcccatgggttaaccccggaacaagtggtggccatcgctagcaacggcggtggcaaacaggccctggagactgttcagcgtctgcttccggtgctgtgccaggcccatgggctaaccccgcagcaagtggttgccattgccagcaatggcggcggcaagcaggctctggaaactgtgcagcgcctgctgccggtgctgtgccaggctcacggtctgaccccgcaacaggtggtggcaatcgcaagcaatggtggtggtcgtccggcactggagagcattgtggctcagctgagccgtccagacccggccctggcggctctgaccaacgatcacctggtggcgctggcttgcctgggcggtcgtccggccctggatgcggtgaagaaaggcctgggt

SEQ ID NO: 307 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASNGGGKQALETVQRLLPVLCQAHGLTPQQVVAIASNIGGKQALETVQRLLPVLCQAHGLTPEQVVAIASNNGGKQALETVQALLPVLCQAHGLTPEQVVAIASHDGGKQALETVQALLPVLCQAHGLTPEQVVAIASHDGGKQALETVQALLPVLCQAHGLTPEQVVAIASNGGGKQALETVQRLLPVLCQAHGLTPEQVVAIASNIGGKQALETVQALLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASNNGGKQALETVQALLPVLCQAHGLTPEQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLG

SEQ ID NO: 308 - DNA, 2025 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccggaacaagtggttgccatcgcatccaatatcggtggtaaacaagccctggagaccgttcaagccctgctgccagtgctgtgccaggctcatggtctgaccccgcagcaggtggtggccattgcgagcaacaatggcggcaagcaggcgctggagaccgtgcagcgtctgctgccggtgctgtgccaagcccatggcctgaccccgcagcaagtggttgctatcgccagcaacattggcggtaaacaggccctggaaaccgtgcagcgcctgttaccggtgctgtgccaggcccatggtctgaccccggagcaggtggtggcgatcgctagcaacatcggcggcaagcaggctctggaaaccgtgcaggccctgcttccggtgctgtgccaggcccatgggctgaccccggaacaagttgtggctattgccagccatgatggcggtaaacaggcgctggaaaccgtgcaggctctgttaccggtgctgtgccaagcgcatggcctgaccccggaacaggtggtggctattgcgagcaatggcggtggcaagcaggccctggagaccgttcaggcgctgttgccggtgctgtgccaggcgcatggcttaaccccggaacaagttgttgcgatcgctagcaacaacggtggcaaacaggctctggagaccgttcagcgtctgttaccggtgctgtgccaggcacatggcctgaccccggagcaagttgttgccattgccagccacgatggtggcaagcaggctctggagaccgtgcaggccctgctcccggtgctgtgccaggcccatggcttaaccccggagcaagttgtggctatcgccagcaacggtggcggtaaacaggcgctggagaccgttcagcgcctgctaccggtgctgtgccaggctcatggcttgaccccggaacaggttgttgccattgcgtccaatatcggcggcaagcaggcgctggaaaccgttcaggctctgcttccggtgctgtgccaggcccatggattaaccccggagcaggttgtggcgattgcgagcaacggcggtggcaaacaggccctggagaccgtgcaggcgctgctaccggtgctgtgccaggctcatgggctgaccccggagcaagtggttgctattgctagcaatggcggcggcaagcaggctctggaaacggtgcaggccctgctgccggtgctgtgccaggcccatgggttaaccccggaacaagtggtggccatcgcttccaatattggcggtaaacaggccctggagactgttcagcgtctgcttccggtgctgtgccaggcccatgggctaaccccgcagcaagttgttgctattgcctccaatggcggtggcaagcaggctctggaaactgtgcagcgcctgctgccggtgctgtgccaggctcacggcctgaccccgcagcaagttgtggcaatcgcaagcaatggtggtggtcgtccggctctggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 309 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPQQVVAIASNIGGKQALETVQRLLPVLCQAHGLTPEQVVAIASNIGGKQALETVQALLPVLCQAHGLTPEQVVAIASHDGGKQALETVQALLPVLCQAHGLTPEQVVAIASNGGGKQALETVQALLPVLCQAHGLTPEQVVAIASNNGGKQALETVQRLLPVLCQAHGLTPEQVVAIASHDGGKQALETVQALLPVLCQAHGLTPEQVVAIASNGGGKQALETVQRLLPVLCQAHGLTPEQVVAIASNIGGKQALETVQALLPVLCQAHGLTPEQVVAIASNGGGKQALETVQALLPVLCQAHGLTPEQVVAIASNGGGKQALETVQALLPVLCQAHGLTPEQVVAIASNIGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLG

SEQ ID NO: 310 - DNA, 2331 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccggaacaagtggtggctatcgcgtcccatgatggtggtaaacaggctctggagaccgtgcaagctctgctgccagtgctgtgccaggcccatggtctgaccccgcagcaggtggtggctattgccagcaatggcggtggcaagcaggcgctggagaccgtgcagcgtctgctgccggtgctgtgccaggctcatggcctgaccccgcagcaagttgtggctattgccagcaacggtggcggtaaacaggccctggagaccgtgcagcgcctgttaccggtgctgtgccaagcccatggcctgaccccggagcaggtggtggcgatcgctagcaacatcggcggcaagcaggctctggaaaccgtgcaggccctgcttccggtgctgtgccaggcccatggcttaaccccggaacaggttgttgctattgccagcaacaacggcggtaaacaggcgctggaaaccgtgcaggctctgttaccggtgctgtgccaggcccatgggctgaccccggaacaagttgtggctattgcgagccatgatggcggcaagcaggccctggaaaccgtgcaggcgctgttgccggtgctgtgccaagcccatggattaaccccggaacaagttgttgcgatcgctagcaacattggcggtaaacaggctctggaaaccgttcagcgtctgttaccggtgctgtgccaggcgcatggtctgaccccggaacaggttgtggccattgcctccaatggcggtggcaagcaggctctggagaccgttcaggccctgctcccggtgctgtgccaagcgcatggcctgaccccggaacaggtggtggctatcgccagcaacattggtggcaaacaggcgctggagaccgttcagcgcctgctaccggtgctgtgccaggcacatggtctgaccccggagcaagttgtggccattgctagccacgatggtggcaagcaggcgctggaaaccgttcaggctctgcttccggtgctgtgccaggcccatggtttaaccccggaacaagtggttgccattgcgtccaatggtggcggtaaacaggccctggaaaccgttcaggcgctgctaccggtgctgtgccaggctcatgggctgaccccggagcaagtggttgctattgcttcccatgatggcggcaagcaggctctggaaacggtgcaggccctgctgccggtgctgtgccaagcccatgggttaaccccggaacaggtggttgcgattgctagccacgacggcggtaaacaggccctggaaacggttcagcgtctgcttccggtgctgtgccaggcccatggacttaccccgcagcaggttgtggcgattgcctccaatggcggtggcaagcaggctctggaaactgtgcagcgcctgctgccggtgctgtgccaggctcatggtttaaccccggagcaggttgttgccatcgccagccacgacggtggcaaacaggcgctggaaactgtgcaggctctgctcccggtgctgtgccaggctcatggacttaccccggagcaggtggttgccattgctagcaacattggtggcaagcaggccctggagactgttcaggcgctgttaccggtgctgtgccaggcccatgggttaaccccggagcaagttgttgccattgcctccaatattggtggcaaacaggctctggagactgttcaggccctgctgccggtgctgtgccaggctcacggtctgaccccgcagcaagtggtggcaatcgcaagcaatggtggtggtcgtccggctctggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 311 - protein, 675 aa, Artificial Sequence; identical to SEQ ID NO: 309
  Synthetic

SEQ ID NO: 312 - DNA, 2229 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccggaacaagtggttgcgattgcgtcccatgatggtggtaaacaagccctggagaccgttcaagctctgctgccagtgctgtgccaggctcatggtctgaccccgcagcaggtggtggctattgccagccatgatggcggcaagcaggctctggagaccgtgcagcgtctgctgccggtgctgtgccaagcccatggcctgaccccgcagcaagttgtggctattgccagcaacggcggtggcaaacaggcgctggaaaccgtgcagcgcctgttaccggtgctgtgccaagcgcatggtctgaccccggagcaggtggtggccatcgctagcaacaacggtggcaagcaggccctggaaaccgtgcaggcgctgttgccggtgctgtgccaggcccatggcttaaccccggaacaagtggtggccattgcgagcaatggtggcggtaaacaggctctggaaaccgtgcaggccctgcttccggtgctgtgccaggcccatgggctgaccccggaacaagttgtggctatcgccagcaacatcggcggcaagcaggcgctggagaccgttcaggctctgttaccggtgctgtgccaggcgcatggcctgaccccggaacaggtggtggcgatcgctagcaacattggcggtaaacaggccctggagaccgttcagcgcctgctcccggtgctgtgccaggcccatggtctgaccccggaacaggttgttgctattgccagcaacaacggcggcaagcaggccctggagaccgtgcaggcgctgctaccggtgctgtgccaggcccatggactgaccccggagcaggttgtggccatcgcgtccaatggcggtggcaaacaggctctggagaccgttcagcgtctgttaccggtgctgtgccaggcacatggcctgaccccggagcaagttgttgccatcgctagcaacattggtggcaagcaggcgctggaaaccgttcagcgcctgctaccggtgctgtgccaggctcatggcttaaccccggagcaggttgtcgccattgccagcaacaatggtggcaaacaggctctggaaactgtgcaggccctgctaccggtgctgtgccaggcccatgggttaaccccggaacaggttgtggccattgcctccaataacggtggcaagcaggcgctggaaacggtgcaggctctgcttccggtgctgtgccaggctcatgggctgaccccggagcaagtggttgctattgcgtccaacattggtggcaaacaggccctggaaaccgttcaggcgctgctcccggtgctgtgccaggcccatgggctaaccccggaacaggtggttgccattgcctccaacaatggtggcaagcaggccctggaaacggttcagcgtctgcttccggtgctgtgccaggcccatgggcttaccccgcagcaagttgttgctatcgccagcaatattggtggcaaacaggctctggaaacggtgcagcgcctgctaccggtgctgtgccaggctcatggtttaaccccgcagcaggtggttgcgattgcctccaacaacggtggcaagcaggcgctggaaactgttcagcgtctgctcccggtgctgtgccaggctcacggcctgaccccgcagcaagtggtggctatcgcctccaacggtggtggtcgcccggctctggaaagcattgtggcgcagctgagccgtccagacccggccctggcggctctgaccaatgatcacctggtggccctggcctgcctgggtggccgtccggctctggatgccgtgaagaaaggtctgggc

SEQ ID NO: 313 - protein, 743 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASHDGGKQALETVQRLLPVLCQAHGLTPQQVVAIASNGGGKQALETVQRLLPVLCQAHGLTPEQVVAIASNNGGKQALETVQALLPVLCQAHGLTPEQVVAIASNGGGKQALETVQALLPVLCQAHGLTPEQVVAIASNIGGKQALETVQALLPVLCQAHGLTPEQVVAIASNIGGKQALETVQRLLPVLCQAHGLTPEQVVAIASNNGGKQALETVQALLPVLCQAHGLTPEQVVAIASNGGGKQALETVQRLLPVLCQAHGLTPEQVVAIASNIGGKQALETVQRLLPVLCQAHGLTPEQVVAIASNNGGKQALETVQALLPVLCQAHGLTPEQVVAIASNNGGKQALETVQALLPVLCQAHGLTPEQVVAIASNIGGKQALETVQALLPVLCQAHGLTPEQVVAIASNNGGKQALETVQRLLPVLCQAHGLTPQQVVAIASNIGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLG

SEQ ID NO: 314 - DNA, 2229 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccggaacaggtggtggcaatcgcaagcaataatggtggtaaacaggctctggaaaccgtgcaagctctgctgccagttctgtgccaggctcatggtctgaccccgcagcaggtggtggctattgccagccatgatggcggcaagcaggccctggagaccgtgcagcgtctgctgccggtgctgtgccaggcccatggcctgaccccgcagcaagttgtggctattgccagcaacggcggtggcaaacaggctctggagaccgtgcagcgcctgttaccggtgctgtgccaagcccatggtctgaccccggagcaggtggtggcgatcgctagcaacattggtggcaagcaggccctggaaaccgtgcaggcgctgttgccggtgctgtgccaagcccatgggctgaccccggaacaagttgttgccattgccagcaacaatggtggcaaacaggctctggaaactgtgcaggccctgcttccggtgctgtgccaggcccatggattaaccccggaacaagttgtggctattgcgagcaatggcggcggcaagcaggcgctggaaaccgtgcaggctctgttaccggtgctgtgccaggcgcatggcctgaccccggagcaagtggtggccatcgctagcaacattggcggtaaacaggcgctggagaccgttcagcgtctgttaccggtgctgtgccaggcacatggccttaccccggaacaagttgtggccattgccagcaacatcggcggcaagcaggccctggaaacggtgcaggcgctgctcccggtgctgtgccaggcccatgggttaaccccggaacaagtggttgctattgctagccatgatggcggtaaacaggccctggagaccgttcagcgcctgctaccggtgctgtgccaggcccatggtttaaccccggaacaggttgttgcgattgctagccacgatggcggcaagcaggctctggagaccgttcaggccctgctcccggtgctgtgccaggcccatgggcttaccccggagcaagttgttgctattgcctccaatattggcggtaaacaggcgctggaaaccgttcaggctctgcttccggtgctgtgccaggctcatggcctcaccccggaacaagttgtggcgattgcgtcccatgatggcggcaagcaggccctggaaactgtgcaggcgctgctaccggtgctgtgccaggcccatgggctaaccccggaacaggtggttgcgattgctagcaacaacggcggtaaacaggctctggagactgttcagcgtctgcttccggtgctgtgccaggctcatgggctgaccccgcagcaagtggttgctattgccagcaatggcggtggcaagcaggcgctggagactgttcagcgcctgctcccggtgctgtgccaggctcatggtttaaccccggagcaggttgtggcgatcgccagcaatggtggcggtaaacaggctctggaaacggtgcaggccctgctcccggtgctgtgccaggctcatggactgaccccggagcaagttgttgccattgcgtcccacgacggcggcaagcaggcgctggagacggtgcaggctctgctcccggtgctgtgccaggctcacggtctgaccccgcaacaggtggtggcaatcgcaagcaacggtggtggtcgtccggcactggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 315 - protein, 743 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQALLPVLCQAHGLTPQQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNNGGKQALETVQALLPVLCQAHGLTPEQVVAIASNGGGKQALETVQALLPVLCQAHGLTPEQVVAIASNIGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQALLPVLCQAHGLTPEQVVAIASNIGGKQALETVQALLPVLCQAHGLTPEQVVAIASHDGGKQALETVQALLPVLCQAHGLTPEQVVAIASNNGGKQALETVQRLLPVLCQAHGLTPQQVVAIASNGGGKQALETVQRLLPVLCQAHGLTPEQVVAIASNGGGKQALETVQALLPVLCQAHGLTPEQVVAIASHDGGKQALETVQALLPVLCQAHGLTPQQVVAIASNGGGRPALESIVAQLSRPDPALAALTNDHLVALACLGGRPALDAVKKGLG

SEQ ID NO: 316 - DNA, 1821 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgaccccacagcaggtggtggcaatcgcaagccacgacggaggcaagcaggccctggagaccgtgcagaggctgctgcccgtgctgtgccaggcacacggactgacacctgaacaggtcgtggcaatcgcatccaacggaggcggcaagcaggccctggaaaccgtgcagcgcctgttacccgtgctgtgccaggcccacggcctgacaccccagcaggtggtggccatcgcctctaatggagggggcaagcaggccctggagacggtgcagcggctgctgcctgtgctgtgccaggctcatggactgacaccagaacaggtggtcgcaatcgcaagcaacggaggtggcaagcaggccctggagactgtgcaggccctgcttcccgtgctgtgccaggctcacggactgacacctcagcaggtcgtcgccatcgcctccaacaatggtggcaagcaggccctggagacagtgcagagactgctgccagtgctgtgccaagcccatggactgacaccacagcaggtcgtcgctatcgcctctaataacggcggcaagcaggccctggagacggtacagaggctgttacccgtgctgtgccaagcacacggactgacaccagagcaggtcgtcgcaatcgccagcaatatcggtggcaagcaggccctggagacggtccagcgcctgctccccgtgctgtgccaagcccacggcctgacccctcagcaggtcgtggctattgctagcaataacgggggcaagcaggccctggagacggttcagcggctgttgcccgtgctgtgccaagcccacggtctgacccctcagcaggtggtcgctattgcttctaatggaggaggcaagcaggccctggagacggtacagagactgttacctgtgctgtgccaggcacatggcctgacaccagagcaggtggtcgctatcgccagcaacataggtggcaagcaggccctggagacggtacagaggctgcttcccgtgctgtgccaagctcatggcctgacacctgaacaggtggtcgccattgctagcaataacggtggcaagcaggccctggagacggtacagcggctgttaccagtgctgtgccaagcacatggcttaacccctcaacaggtcgtcgcaattgcctctaatatcggaggcaagcaggccctggagacggtacagcggctgctccccgtgctgtgccaggcgcacggcctgactcctcagcaggtcgtggcaatcgccagcaacatcggcggcagacctgccctggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 317 - protein, 607 aa, Artificial Sequence; identical to SEQ ID NO: 11
  Synthetic

SEQ ID NO: 318 - DNA, 1488 bp, Artificial Sequence
  Synthetic
ctgacccctgagcaggtggtggccatcgccagcaatatcggaggcaagcaggccctggagaccgtgcaggccctgctgcccgtgctgtgccaggcacacggactgacacctcagcaggtcgtcgccatcgcctccaacaatggcggcaagcaggccctggaaaccgtgcagaggctgttacccgtgctgtgccaggcccacggcctgacaccccagcaggtggtggcaatcgcatctcacgatgggggcaagcaggccctggagacggtgcagcgcctgctgcctgtgctgtgccaggctcatggactgacaccagaacaggtcgtggccatcgccagcaacattggcggcaagcaggccctggagactgtccaggccctgttacccgtgctgtgccaagcccatggactgacacctgaacaggtcgtggcaatcgcatccaatggaggtggcaagcaggccctggagacagtgcaggccctgctgccagtgctgtgccaggctcacggcctgacaccagaacaggtggtcgcaatcgcatctaatggaggaggcaagcaggccctggagacggtacaggccctgttgcccgtgctgtgccaagcccacggactgacaccagagcaggtcgtcgctattgcttccaacattggaggcaagcaggccctggagacggtccagcggctgcttcccgtgctgtgccaagctcatggcctgacaccagagcaggtggtcgctattgcctccaacaatggaggcaagcaggccctggagacggttcaggccctgcttcccgtgctgtgccaggctcatggtctgacacccgaacaggtggtcgctatcgcctctcacgatggaggcaagcaggccctggagacggtacagaggctgttacctgtgctgtgccaggcccatgggctgaccccagaacaggtggtcgccatcgccagcaacatcggcggcaagcaggccctggagacggtacaggccctgctccccgtgctgtgccaagcacatggcctgacacccgagcaggtcgtggctattgctagcaacaacgggggcaagcaggccctggagacggtacaggccctgctaccagtgctgtgccaagcgcacgggctgaccccagagcaggtcgtcgcaatcgcctctaacaacggtggcaagcaggccctggagacggtacaggccctgctgcccgtgctgtgccaagcgcatgggctgactccagaacaggtggtggctatcgccagcaacattggaggcaagcaggccctggagacggtacagcggctgctacccgtgctgtgccaagcgcacggtctgacacctcagcaggtggtcgctatcgcttctaacatagggggcaagcaggccctggagacggtacagcggctgctgcccgtgctgtgccaagcgcacggactgaccccacagcaggtcgtcgctatcgcctctaacggaggaggcagacccgccctggag

SEQ ID NO: 319 - protein, 496 aa, Artificial Sequence
  Synthetic
LTPEQVVAIASNIGGKQALETVQALLPVLCQAHGLTPQQVVAIASNNGGKQALETVQRLLPVLCQAHGLTPQQVVAIASHDGGKQALETVQRLLPVLCQAHGLTPEQVVAIASNIGGKQALETVQALLPVLCQAHGLTPEQVVAIASNGGGKQALETVQALLPVLCQAHGLTPEQVVAIASNGGGKQALETVQALLPVLCQAHGLTPEQVVAIASNIGGKQALETVQRLLPVLCQAHGLTPEQVVAIASNNGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNNGGKQALETVQALLPVLCQAHGLTPEQVVAIASNNGGKQALETVQALLPVLCQAHGLTPEQVVAIASNIGGKQALETVQRLLPVLCQAHGLTPQQVVAIASNIGGKQALETVQRLLPVLCQAHGLTPQQVVAIASNGGGRPALE

SEQ ID NO: 320 - DNA, 2127 bp, Artificial Sequence
  Synthetic
gacatcgcggatctgcgtaccctgggttacagccagcagcagcaggagaagatcaagccgaaggtgcgcagcaccgtggctcagcaccacgaagccctggtgggccacggtttcacccacgctcacatcgtggccctgagccagcacccagccgcgctgggcaccgtggccgtgaaatatcaggacatgattgctgccctgccagaggccacccatgaagctattgtgggcgtgggcaagcagtggagcggtgctcgtgcgctggaggcgctgctgaccgtggctggtgaactgcgtggtccgccgctgcagctggataccggtcagctgctgaaaattgccaaacgtggcggtgtgaccgcggtggaagccgtgcatgcttggcgtaatgctctgaccggtgcgccgctgaacctgaccccgcagcaggtggtggctattgccagcaacaacggcggtaaacaggctctggagaccgtgcagcgtctgctgccggtgctgtgccaggctcatggtctgaccccggagcaggtggtggccattgctagccatgatggcggcaagcaggcgctggaaaccgtgcagcgcctgttaccggtgctgtgccaagcccatggtctgaccccgcagcaagttgtggctattgcgagcaacggcggtggcaaacaggccctggaaaccgttcagcgtctgttaccggtgctgtgccaggcccatggcctgaccccggaacaagtggtggctatcgccagcaacattggtggcaagcaggccctggaaaccgtgcaggcgctgttgccggtgctgtgccaagcccatgggctgaccccgcagcaagtggttgcgatcgctagcaacaacggtggcaaacaggctctggaaaccgttcagcgcctgcttccggtgctgtgccaagcgcatggcttaaccccgcagcaagttgtggccattgcgagcaacaacggtggcaagcaggcgctggagaccgttcagcgtctgcttccggtgctgtgccaggcgcatggcctgaccccggagcaagtggtggctattgctagccacgatggtggcaaacaggccctggagaccgtgcagcgcctgctcccggtgctgtgccaggcccatggattaaccccgcagcaagtggtggccatcgccagcaatggcggcggcaagcaggctctggaaactgtgcagcgtctgttaccggtgctgtgccaggcccatgggttaaccccgcagcaggttgttgccattgcctccaataatggcggtaaacaggcgctggagactgtgcagcgcctgctaccggtgctgtgccaggcacatggtctgaccccggaacaagttgttgccattgcgtcccatgatggcggcaagcaggccctggagactgttcagcgtctgctcccggtgctgtgccaggcccatggtttaaccccggaacaagttgtggccattgctagccacgatggcggtaaacaggctctggaaactgttcagcgcctgctgccggtgctgtgccaagcacatggcttaaccccggaacaggttgttgctattgccagcaacatcggcggcaagcaggctctggagaccgttcaggccctgttgccggtgctgtgccaggcccatgggcttaccccggaacaagtggttgccatcgccagcaacattggcggtaaacaggcgctggaaaccgttcaggctctgttgccggtgctgtgccaggctcatggccttaccccgcagcaagttgtggcgattgctagcaatggcggtggcaagcaggcgctggagacggttcagcgtctgctaccggtgctgtgccaggctcatggattgaccccgcagcaggtcgtggccattgcctccaataacggtggcaaacaggcgctggagacagttcagcgcctgctgccggtgctgtgccaggctcatgggttgaccccgcagcaggtagttgctattgctagcaatggtggcggtcgtccggccctggagagcattgtggcgcagctgagccgtccagacccggcgctggcggctctgaccaacgatcacctggtggcgctggcttgcctgggcggtcgtccggccctggatgccgtgaagaaaggcctgggt

SEQ ID NO: 321 - protein, 709 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLG

SEQ ID NO: 322 - DNA, 2025 bp, Artificial Sequence
  Synthetic
gacatcgcggatctgcgtaccctgggttacagccagcagcagcaggagaagatcaagccgaaggtgcgcagcaccgtggctcagcaccacgaagccctggtgggccacggtttcacccacgctcacattgtggccctgagccagcacccagccgcgctgggcaccgtggccgtgaaatatcaggatatgattgctgccctgccagaggccacccatgaagctattgtgggcgtgggcaagcagtggagcggtgctcgtgcgctggaggcgctgctgaccgtggctggtgaactgcgtggtccgccgctgcagctggacaccggtcagctgctgaaaatcgcgaaacgtggcggtgtgaccgcggtggaagccgtgcatgcttggcgtaatgctctgaccggtgcgccgctgaacctgacccctgagcaggtggtggcaatcgcaagccacgacggaggcaagcaggccctggagacagtgcaggccctgctgcccgtgctgtgccaggcacacggcctgacacctgagcaggtggtggccatcgcctccaacatcggcggcaagcaggccctggagacagtacagaggctgttacccgtgctgtgccaggcccacggcctgacaccccagcaggtcgtcgccatcgcctctaatattggaggcaagcaggccctggagacagtccagcgcctgctgcctgtgctgtgccaggctcatggcctgacaccagaacaggtcgtggccatcgccagtaatattgggggcaagcaggccctggagacagttcaggccctgttacccgtgctgtgccaagcccatggcctgacacctgaacaggtggtcgccatcgcctccaatattggtggcaagcaggccctggagacagtacaggccctgctgccagtgctgtgccaggctcacggcctgacaccagagcaggtcgtcgcaatcgcatctcatgatggcggcaagcaggccctggagacagtacaggccctgttacccgtgctgtgccaagcgcacggcctgacccctgaacaggtcgtggctattgcaagccacgatggtggcaagcaggccctggagacagtacagcggctgcttcccgtgctgtgccaagctcatggcctgacacctgagcaggtcgtcgctattgctagcaatattggcggcaagcaggccctggagacagtacaggccctgctccccgtgctgtgccaagcacacggcctgacacccgaacaggtggtggctatcgcctctaatggaggtggcaagcaggccctggagacagtacagaggctgcttcctgtgctgtgccaggcccatggcctgacccctgagcaggtcgtggctattgccagtaatataggaggcaagcaggccctggagacagtacaggccctgctacccgtgctgtgccaagcgcatggcctgaccccagaacaggtcgtggcaatcgcatctcatgacggcggcaagcaggccctggagacagtacaggccctgctaccagtgctgtgccaagcacatggcctgacccccgaacaggtggtggcaatcgcctctcacgacgggggcaagcaggccctggagacagtacaggccctgctacccgtgctgtgccaagcgcacggcctgacgccagaacaggtggtcgctatcgcaagcaacggcggtggcaagcaggccctggagacagtacagcggctgctacccgtgctgtgccaagcgcacggcctgactcctcagcaggtcgtcgctatcgcatctcatgatggtggcaagcaggccctggagacagtacagcggctgctacccgtgctgtgccaagcgcacggcctgacaccacagcaggtcgtcgcaattgcatctaacggaggaggcagacccgccctggagagcattgtggctcagctgagccgtccagacccggccctggcggctctgaccaacgatcacctggtggcgctggcttgcctgggcggtcgtccggccctggatgcggtgaagaaaggcctgggt

SEQ ID NO: 323 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPEQVVAIASNIGGKQALETVQRLLPVLCQAHGLTPQQVVAIASNIGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNGGGKQALETVQRLLPVLCQAHGLTPEQVVAIASNIGGKQALETVQALLPVLCQAHGLTPEQVVAIASHDGGKQALETVQALLPVLCQAHGLTPEQVVAIASHDGGKQALETVQALLPVLCQAHGLTPEQVVAIASNGGGKQALETVQRLLPVLCQAHGLTPQQVVAIASHDGGKQALETVQRLLPVLCQAHGLTPQQVVAIASNGGGRPALESIVAQLSRPDPALAALTNDHLVALACLGGRPALDAVKKGLG

SEQ ID NO: 324 - DNA, 1923 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgacaccacagcaggtcgtcgctatcgcttcaaacattggggggaaacaggcactggaaaccgtccagagactgctgcccgtcctgtgccaggcccacggcctgacccctgagcaggtggtggccatcgccagcaatatcggaggcaagcaggccctggagaccgtgcagcggctgctgcccgtgctgtgccaagcccacggcttaacacctcagcaggtcgtggctatcgcctccaacaatggcggcaagcaggccctggagacggtgcagagactgctgccagtgctgtgccaggcccacggcttaacaccagaacaggtcgtggccatcgcctctaacattggcggcaagcaggccctggagactgtgcaggccctgctgcccgtgctgtgccaggcccacggccttacaccacagcaggtggtggcaatcgccagcaatggagggggcaagcaggccctggagacagtgcagaggctgctgcccgtgctgtgccaagcccacggcctgacacctcagcaggtggtcgccatcgcctccaacggaggtggcaagcaggccctggagacggtacagcgcctgctgcccgtgctgtgccaagcccacggcctaacacccgaacaggtcgtcgccatcgcctctaacatcggcggcaagcaggccctggagacggtccagcggctgctgcctgtgctgtgccaagcccacggccttacccctcagcaggtcgtggcaatcgccagcaacaatggtggcaagcaggccctggagacggttcagagactgctgcccgtgctgtgccaagcccacggcctcacacctcagcaggtggtggccattgcctccaacggaggaggcaagcaggccctggagacggtacagaggctgctgccagtgctgtgccaggcccacggcctaacaccagaacaggtggtcgctattgcctctaacattggtggcaagcaggccctggagacggtacagcgcctgctgcccgtgctgtgccaagcccacggcctaacgccagaacaggtcgtcgctatcgccagcaacggaggaggcaagcaggccctggagacggtacagcggctgctgcccgtgctgtgccaagcccacggcctaaccccacagcaggtcgtggccattgcctccaataacggcggcaagcaggccctggagacggtacagcggctgctgcccgtgctgtgccaagcccacggcctaactccccagcaagtcgtcgctattgcctctaataacgggggcaagcaggccctggagacggtacagagactgctgcccgtgctgtgccaagcccacggcctgacaccacagcaggtcgtcgccatcgcaagcaacggaggagggaggcccgcactggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 325 - protein, 641 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNIGGKQALETVQRLLPVLCQAHGLTPEQVVAIASNIGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQRLLPVLCQAHGLTPEQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLG

SEQ ID NO: 326 - DNA, 2025 bp, Artificial Sequence
  Synthetic
gacatcgcggatctgcgtaccctgggttacagccagcagcagcaggagaagatcaagccgaaggtgcgcagcaccgtggctcagcaccacgaagccctggtgggccacggtttcacccacgctcacattgtggccctgagccagcacccagccgcgctgggcaccgtggccgtgaaatatcaggatatgattgctgccctgccagaggccacccatgaagctattgtgggcgtgggcaagcagtggagcggtgctcgtgcgctggaggcgctgctgaccgtggctggtgaactgcgtggtccgccgctgcagctggacaccggtcagctgctgaaaatcgcgaaacgtggcggtgtgaccgcggtggaagccgtgcatgcttggcgtaatgctctgaccggtgcgccgctgaacctgactcccgaacaggtggtcgctatcgcttctcatgatggcggaaaacaggctctggaaaccgtccaggctctgctgcccgtgctgtgccaggcccacggcctgaccccacagcaggtcgtcgcaatcgccagcaatatcggaggcaagcaggccctggagaccgtgcagcggctgctgcccgtgctgtgccaagcccacggcttaacacctcagcaggtggtggccatcgcctccaacaatggcggcaagcaggccctggagacggtgcagagactgctgccagtgctgtgccaggcccacggcttaacaccagaacaggtcgtggcaatcgcctctaacggagggggcaagcaggccctggagactgtgcaggccctgctgcccgtgctgtgccaggcccacggccttacaccagaacaggtggtcgccattgccagcaatggaggtggcaagcaggccctggagacagtccaggccctgctgcccgtgctgtgccaagcccacggcctgacacctgaacaggtggtcgcaatcgcctcccacgatgggggcaagcaggccctggagacggtacaggccctgctgcccgtgctgtgccaagcccacggcctaacacccgaacaggtggtggccattgcctctaacggaggaggcaagcaggccctggagacggtccagcggctgctgcctgtgctgtgccaagcccacggccttacccctgaacaagtcgtggccatcgccagcaatggaggaggcaagcaggccctggagacggttcaggccctgctgcccgtgctgtgccaagcccacggcctcacacctgaacaagttgtggccatcgcctcccacgatggtggcaagcaggccctggagacggtacagaggctgctgccagtgctgtgccaggcccacggcctaacaccagaacaggtggtggctatcgcctctaacattggcggcaagcaggccctggagacggtacaggccctgctgcccgtgctgtgccaagcccacggcctaacgccagaacaggtcgtcgctattgccagcaacattgggggcaagcaggccctggagacggtacaggccctgctgcccgtgctgtgccaagcccacggcctaacccctgaacaggtggtggcaatcgcctccaacattggtggcaagcaggccctggagacggtacaggccctgctgcccgtgctgtgccaagcccacggcctaactcccgagcaggtcgtcgccatcgcctctaatggcggcggcaagcaggccctggagacggtacagaggctgctgcctgtgctgtgccaagcccacggcctaacgccgcagcaagtcgtcgctattgccagcaatattggcggcaagcaggccctggagacggtacagcgcctgctgcccgtgctgtgccaagcccacggcctgaccccccagcaggtggtggcaatcgcttcaaacggaggagggagacccgctctggaaagcattgtggctcagctgagccgtccagacccggccctggcggctctgaccaacgatcacctggtggcgctggcttgcctgggcggtcgtccggccctggatgcggtgaagaaaggcctgggt

SEQ ID NO: 327 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASNIGGKQALETVQRLLPVLCQAHGLTPQQVVAIASNNGGKQALETVQRLLPVLCQAHGLTPEQVVAIASNGGGKQALETVQALLPVLCQAHGLTPEQVVAIASNGGGKQALETVQALLPVLCQAHGLTPEQVVAIASHDGGKQALETVQALLPVLCQAHGLTPEQVVAIASNGGGKQALETVQRLLPVLCQAHGLTPEQVVAIASNGGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNGGGKQALETVQRLLPVLCQAHGLTPQQVVAIASNIGGKQALETVQRLLPVLCQAHGLTPQQVVAIASNGGGRPALESIVAQLSRPDPALAALTNDHLVALACLGGRPALDAVKKGLG

SEQ ID NO: 328 - DNA, 1719 bp, Artificial Sequence
  Synthetic
gacatcgcggatctgcgtaccctgggttacagccagcagcagcaggagaagatcaagccaaaggtgcgcagcaccgtggcccagcaccatgaagctctggtgggtcacggcttcacccacgcgcacatcgtggctctgagccagcacccagccgcgctgggtaccgtggccgtgaaatatcaggacatgattgctgccctgccagaggctacccatgaagcgattgtgggtgtgggcaagcagtggagcggtgctcgtgcgctggaggccctgctgaccgtggccggtgaactgcgtggcccgccgctgcagctggataccggccagctgctgaaaatcgcgaaacgtggcggtgtgaccgctgtggaagctgtgcatgcctggcgtaatgctctgaccggtgccccgctgaacctgacccctcagcaggtggtggccatcgccagcaacatcggcggcaagcaggccctggagacagtgcagaggctgctgcccgtgctgtgccaggcacacggcctgacacctgagcaggtggtggcaatcgcatccaatggaggaggcaagcaggccctggagacagtacagcgcctgttacccgtgctgtgccaggcccacggcctgacaccccagcaggtcgtcgccatcgcctctaacaatgggggcaagcaggccctggagacagtccagcggctgctgcctgtgctgtgccaggctcatggcctgacaccagaacaggtcgtggctattgccagcaacaatggtggcaagcaggccctggagacagttcaggccctgcttcccgtgctgtgccaggctcacggcctgacaccacagcaggtcgtggccatcgcctccaacaatggcggcaagcaggccctggagacagtacagagactgctgccagtgctgtgccaagcccatggcctgacccctcagcaggtcgtggcaatcgcatctcacgacggtggcaagcaggccctggagacagtacagaggctgttacccgtgctgtgccaagcacacggcctgacaccagagcaggtcgtcgcaatcgcaagcaacggcggcggcaagcaggccctggagacagtacagcgcctgctccccgtgctgtgccaagcccacggcctgacacctcagcaggtggtcgccattgccagcaacggcgggggcaagcaggccctggagacagtacagcggctgttgcccgtgctgtgccaagcccacggcctgacgccccagcaggtggtcgccatcgcatctaacggcggtggcaagcaggccctggagacagtacagcggctgcttcctgtgctgtgccaggcccatggcctgacccccgaacaggtcgtggctatcgctagcaacaatggcggcaagcaggccctggagacagtacagagactgttacccgtgctgtgccaagcgcatggcctgacccctgaacaggtcgtggcaattgcctccaataacggtggcaagcaggccctggagacagtacagcggctgctaccagtgctgtgccaagcacatggcctgaccccccagcaggtcgtggctattgcatctaatggaggaggcagacccgccctggagagcattgtggcgcagctgagccgtccagacccggccctggcggctctgaccaatgatcacctggtggccctggcctgcctgggtggccgtccggctctggatgccgtgaagaaaggtctgggc

SEQ ID NO: 329 - protein, 573 aa, Artificial Sequence; identical to SEQ ID NO: 12
  Synthetic

SEQ ID NO: 330 - DNA, 2127 bp, Artificial Sequence
  Synthetic
gacatcgcggatctgcgtaccctgggttacagccagcagcagcaggagaagatcaagccgaaggtgcgcagcaccgtggctcagcaccacgaagccctggtgggccacggtttcacccacgctcacatcgtggccctgagccagcacccagccgcgctgggcaccgtggccgtgaaatatcaggacatgattgctgccctgccagaggccacccatgaagctattgtgggcgtgggcaagcagtggagcggtgctcgtgcgctggaggcgctgctgaccgtggctggtgaactgcgtggtccgccgctgcagctggataccggtcagctgctgaaaatcgcgaaacgtggcggtgtgaccgcggtggaagccgtgcatgcttggcgtaatgctctgaccggtgcgccgctgaacctgaccccggagcaggtggtggctatcgccagcaacattggcggtaaacaggccctggaaaccgtgcaggcgctgctgccggtgctgtgccaggctcatggtctgaccccgcagcaggtggtggcgatcgctagcaacggcggtggcaagcaggctctggagaccgtgcagcgtctgttaccggtgctgtgccaagcccatggcctgaccccgcagcaagttgtggccattgcgagcaatggtggcggtaaacaggcgctggaaaccgtgcagcgcctgttgccggtgctgtgccaagcccatgggctgaccccggaacaagttgttgctatcgccagcaacatcggcggcaagcaggctctggaaaccgtgcaggccctgcttccggtgctgtgccaagcgcatggtctgaccccggaacaagtggtggccatcgcttccaatattggcggtaaacaggcgctggagaccgtgcaggctctgctcccggtgctgtgccaagcacatggtctgaccccggagcaagttgtggctattgcctccaatatcggcggcaagcaggccctggagaccgttcaggcgctgttaccggtgctgtgccaggcccatggattaaccccggagcaagtggtggctattgctagccatgatggcggtaaacaggccctggagactgttcagcgtctgctaccggtgctgtgccaggcccatggtttaaccccggaacaggttgttgccatcgcttccaacatcggcggcaagcaggctctggaaacggtgcaggccctgttaccggtgctgtgccaggcccatgggttaaccccggaacaagttgtggccattgcctcccatgacggcggtaaacaggctctggagaccgttcagcgcctgctaccggtgctgtgccaggcgcatggcttaaccccggaacaagtggttgccattgcgtccaatatcggcggcaagcaggcgctggagaccgttcaggctctgcttccggtgctgtgccaggcacatggccttaccccggaacaagtggtcgcgatcgcttccaacattggcggtaaacaggccctggaaacggttcaggcgctgcttccggtgctgtgccaggcccatgggcttaccccggaacaggttgtggctattgccagtaatatcggcggcaagcaggctctggaaactgtgcaggccctgctaccggtgctgtgccaggctcatgggctgaccccggagcaagtggttgccattgcctcccatgatggcggtaaacaggcgctggaaacggtgcagcgtctgcttccggtgctgtgccaggctcatggcttaaccccgcagcaagttgttgcgattgctagcaatggcggtggcaagcaggccctggaaactgttcagcgcctgttaccggtgctgtgccaggcccatgggctaaccccggaacaggtggttgctattgccagcaacattggtggcaaacaggcgctggaaactgtgcaggctctgcttccggtgctgtgccaggcccatgggctgaccccgcagcaagtggttgctattgctagcaatggtggcggtcgtccggccctggagagcattgtggcgcagctgagccgtccagacccggccctggcggctctgaccaacgatcacctggtggcgctggcttgcctgggcggtcgtccggccctggatgcggtgaagaaaggcctgggt

SEQ ID NO: 331 - protein, 709 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLG

SEQ ID NO: 332 - DNA, 20 bp, Artificial Sequence
  Synthetic
ccactggggcctcaacactc

SEQ ID NO: 333 - DNA, 20 bp, Artificial Sequence
  Synthetic
gaggcccccagagcagccac

SEQ ID NO: 334 - DNA, 22 bp, Artificial Sequence
  Synthetic
tctgtgcccctccctccctggc

SEQ ID NO: 335 - DNA, 23 bp, Artificial Sequence
  Synthetic
gcccctccctccctggcccaggt

SEQ ID NO: 336 - DNA, 22 bp, Artificial Sequence
  Synthetic
ccctccctggcccaggtgaagg

SEQ ID NO: 337 - DNA, 22 bp, Artificial Sequence
  Synthetic
gtgtggttccagaaccggagga

SEQ ID NO: 338 - protein, 138 aa, Artificial Sequence
  Synthetic
GSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGAIPVKRGATGETKVFTGNSNSPKSPTKGGC

SEQ ID NO: 339 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 340 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 341 - protein, 83 aa, Artificial Sequence
  Synthetic
TNLSDIIEKETGKQLVIQESILMLPEEVEEVIGNKPESDILVHTAYDESTDENVMLLTSDAPEYKPWALVIQDSNGENKIKML

SEQ ID NO: 342 - protein, 17 aa, Artificial Sequence
  Synthetic
KRTADGSEFEPKKKRKV

SEQ ID NO: 343 - protein, 32 aa, Artificial Sequence; identical to SEQ ID NO: 102
  Synthetic

SEQ ID NO: 344 - protein, 10 aa, Artificial Sequence
  Synthetic
GGGGSGGGGS

SEQ ID NO: 345 - protein, 10 aa, Artificial Sequence
  Synthetic
EAAAKEAAAK

SEQ ID NO: 346 - protein, 5 aa, Artificial Sequence
  Synthetic
EAAAK

SEQ ID NO: 347 - protein, 10 aa, Artificial Sequence
  Synthetic
SGGSGGSGGS

SEQ ID NO: 348 - protein, 4 aa, Artificial Sequence
  Synthetic
SGGS

SEQ ID NO: 349 - protein, 44 aa, Artificial Sequence
  Synthetic
GSYALGPYQISAPQLPAYNGQTVGTFYYVNDAGGLESKVFSSGG

SEQ ID NO: 350 - protein, 94 aa, Artificial Sequence
  Synthetic
PTPYPNYANAGHVEGQSALFMRDNGISEGLVFHNNPEGTCGFCVNMTETLLPENAKMTVVPPEGAIPVKRGATGETKVFTGNSNSPKSPTKGGC

SEQ ID NO: 351 - protein, 108 aa, Artificial Sequence; identical to SEQ ID NO: 284
  Synthetic

SEQ ID NO: 352 - protein, 30 aa, Artificial Sequence; identical to SEQ ID NO: 286
  Synthetic

SEQ ID NO: 353 - protein, 1367 aa, Artificial Sequence; identical to SEQ ID NO: 339
  Synthetic

SEQ ID NO: 354 - protein, 1086 aa, Artificial Sequence
  Synthetic
GKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGGSPKKKRKVSSDYKDHDGDYKDHDIDYKDDDDK

SEQ ID NO: 355 - protein, 83 aa, Artificial Sequence; identical to SEQ ID NO: 341
  Synthetic

SEQ ID NO: 356 - protein, 17 aa, Artificial Sequence
  Synthetic
KRTADGSEFEPKKKRKV

SEQ ID NO: 357 - protein, 32 aa, Artificial Sequence; identical to SEQ ID NO: 102
  Synthetic

SEQ ID NO: 358 - protein, 10 aa, Artificial Sequence
  Synthetic
SGGSGGSGGS

SEQ ID NO: 359 - protein, 4 aa, Artificial Sequence
  Synthetic
SGGS

SEQ ID NO: 360 - protein, 763 aa, Artificial Sequence; identical to SEQ ID NO: 5
  Synthetic

SEQ ID NO: 361 - protein, 711 aa, Artificial Sequence; identical to SEQ ID NO: 10
  Synthetic

SEQ ID NO: 362 - protein, 777 aa, Artificial Sequence; identical to SEQ ID NO: 305
  Synthetic

SEQ ID NO: 363 - protein, 675 aa, Artificial Sequence; identical to SEQ ID NO: 307
  Synthetic

SEQ ID NO: 364 - protein, 675 aa, Artificial Sequence; identical to SEQ ID NO: 309
  Synthetic

SEQ ID NO: 365 - protein, 777 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNNGGKQALETVQALLPVLCQAHGLTPEQVVAIASHDGGKQALETVQALLPVLCQAHGLTPEQVVAIASNIGGKQALETVQRLLPVLCQAHGLTPEQVVAIASNGGGKQALETVQALLPVLCQAHGLTPEQVVAIASNIGGKQALETVQRLLPVLCQAHGLTPEQVVAIASHDGGKQALETVQALLPVLCQAHGLTPEQVVAIASNGGGKQALETVQALLPVLCQAHGLTPEQVVAIASHDGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLG

SEQ ID NO: 366 - protein, 743 aa, Artificial Sequence; identical to SEQ ID NO: 313
  Synthetic

SEQ ID NO: 367 - protein, 743 aa, Artificial Sequence; identical to SEQ ID NO: 315
  Synthetic

SEQ ID NO: 368 - protein, 607 aa, Artificial Sequence; identical to SEQ ID NO: 11
  Synthetic

SEQ ID NO: 369 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPQQVVAIASHDGGKQALETVQRLLPVLCQAHGLTPEQVVAIASNIGGKQALETVQALLPVLCQAHGLTPEQVVAIASNGGGKQALETVQALLPVLCQAHGLTPEQVVAIASNGGGKQALETVQALLPVLCQAHGLTPEQVVAIASNIGGKQALETVQRLLPVLCQAHGLTPEQVVAIASNNGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNNGGKQALETVQALLPVLCQAHGLTPEQVVAIASNNGGKQALETVQALLPVLCQAHGLTPEQVVAIASNIGGKQALETVQRLLPVLCQAHGLTPQQVVAIASNIGGKQALETVQRLLPVLCQAHGLTPQQVVAIASNGGGRPALESIVAQLSRPDPALAALTNDHLVALACLGGRPALDAVKKGLG

SEQ ID NO: 370 - protein, 709 aa, Artificial Sequence; identical to SEQ ID NO: 321
  Synthetic

SEQ ID NO: 371 - protein, 675 aa, Artificial Sequence
  Synthetic
DIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASNIGGKQALETVQRLLPVLCQAHGLTPQQVVAIASNIGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNGGGKQALETVQRLLPVLCQAHGLTPEQVVAIASNIGGKQALETVQALLPVLCQAHGLTPEQVVAIASHDGGKQALETVQALLPVLCQAHGLTPEQVVAIASHDGGKQALETVQALLPVLCQAHGLTPEQVVAIASNGGGKQALETVQRLLPVLCQAHGLTPQQVVAIASHDGGKQALETVQRLLPVLCQAHGLTPQQVVAIASNGGGRPALESIVAQLSRPDPALAALTNDHLVALACLGGRPALDAVKKGLG

SEQ ID NO: 372 - protein, 641 aa, Artificial Sequence; identical to SEQ ID NO: 325
  Synthetic

SEQ ID NO: 373 - protein, 675 aa, Artificial Sequence; identical to SEQ ID NO: 327
  Synthetic

SEQ ID NO: 374 - protein, 573 aa, Artificial Sequence; identical to SEQ ID NO: 12
  Synthetic

SEQ ID NO: 375 - protein, 709 aa, Artificial Sequence; identical to SEQ ID NO: 331
  Synthetic

SEQ ID NO: 376 - protein, 124 aa, Artificial Sequence
  Synthetic
DGNEHWEVHPGLSLSDFEVVYGNNPHQIVKLRLDKEVGGSGGSMVQNDFIDSYTLCWLLRDDSGGGGSMVQNDFIDSYTLCWLLRDDDGNEHWEVHPGLSLSDFEVVYGNNPHQIVKLRLDKEV

SEQ ID NO: 377 - protein, 138 aa, Artificial Sequence
  Synthetic
GSYALGPYQISAPQLPAYNGQTVGTFYYVNDAGGLESKVFSSGGPTPYPNYANAGHVEGQSALFMRDNGISEGLVFHNNPEGTCGFCVNMIETLLPENAKMTVVPPEGAIPVKRGATGETKVFTGNSNSPKSPTKGGC

SEQ ID NO: 378 - protein, 138 aa, Artificial Sequence
  Synthetic
GSYALGPYQISAPQLPAYNGQTVGAFYYVNDAGGLESKVFSSGGPTPYPNYANAGHVEGQSALFMRDNGISEGLVFHNNPEGTCGFCVNMIETLLPENAKMTVVPPEGAIPVKRGATGETKVFTGNSNSPKSPTKGGC

SEQ ID NO: 379 - protein, 138 aa, Artificial Sequence
  Synthetic
GSYALGPYQISAPQLPAYNGRTVGTFYYVNDAGGLESKVFISGGPTPYPNYANAGHVEGQSALFMRDNGISEGLVFHNNPEGTCGFCVNMIETLLPENAKMTVVPPEGAIPVKRGATGETKVFTGNSNSPKSPTKGGC

SEQ ID NO: 380 - protein, 138 aa, Artificial Sequence
  Synthetic
GSYALGPYQISAPQLPAYNGQTVGTFYYVNDAGGLESKVFSSGGPTPYPNYANAGHVEGQSALFMRDNGISEGLVFHNNPEGTCGFCVNMIETLLPENAKMTVVPPEGAIPVKRGATGETKVFIGNSNSPKSPTKGGC

SEQ ID NO: 381 - protein, 138 aa, Artificial Sequence
  Synthetic
GSYALGPYQISAPQLPAYNGQTVGAFYYVNDAGGLESKVFSSGGPTPYPNYANAGHVEGQSALFMRDNGISEGLVFHNNPEGTCGFCVNMIETLLPENAKMTVVPPKGAIPVKRGATGETKVFTGNSNSPKSPTKGGC

SEQ ID NO: 382 - protein, 578 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSTSGSLSRHIRTHTGEKPFQCDICMRNFSQSGSLTRHIRTHTGSEKPFQCDICMRNFSRSDALSQHIRTHTGEKPFQCDICMRNFSRNDNRITHIRTHTGEKPFQCDICMRNFSRSDHLTQHTKIHLRGSGGGGSGGSGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 383 - protein, 500 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSQASNLISHIRTHTGEKPFQCDICMRNFSTSHSLTEHIRTHTGSEKPFQCDICMRNFSERSHLREHIRTHTGEKPFQCDICMRNFSQSGNLTEHIRTHTGEKPFQCDICMRNFSSKKALTEHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 384 - protein, 500 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSQASNLISHIRTHTGEKPFQCDICMRNFSQRANLRAHIRTHTGSEKPFQCDICMRNFSQASNLISHIRTHTGEKPFQCDICMRNFSTSHSLTEHIRTHTGEKPFQCDICMRNFSERSHLREHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 385 - protein, 578 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSRSDNLSTHIRTHTGEKPFQCDICMRNFSDRSDLSRHIRTHTGEKPFQCDICMRNFSQSGDLTRHIRTHTGSEKPFQCDICMRNFSRSDSLSAHIRTHTGEKPFQCDICMRNFSQKATRITHTKIHLRGSGGGGSGGSGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 386 - protein, 500 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSQSSSLVRHIRTHTGEKPFQCDICMRNFSRSDNLVRHIRTHTGSEKPFQCDICMRNFSQAGHLASHIRTHTGEKPFQCDICMRNFSRKDNLKNHIRTHTGEKPFQCDICMRNFSRKDALRGHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 387 - protein, 500 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKGSLQKKLEELELDAAMAERPFQCDICMRNFSRSDHLTTHIRTHTGEKPFQCDICMRNFSQSSSLVRHIRTHTGSEKPFQCDICMRNFSRSDNLVRHIRTHTGEKPFQCDICMRNFSQAGHLASHIRTHTGEKPFQCDICMRNFSRKDNLKNHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKMLGSGATNFSLLKQAGDVEENPGPMASVLTPLLLRGLTGSARRLPVPRAKIHSLGSTNLSDIIEKETGKQLVIQESILMLPEEVEEVIGNKPESDILVHTAYDESTDENVMLLTSDAPEYKPWALVIQDSNGENKIKML

SEQ ID NO: 388 - protein, 428 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSTSGSLSRHIRTHTGEKPFACDICGRKFAQSGSLTRHTKIHTGGQRPFQCRICMRNFSRSDALSQHIRTHTGEKPFACDICGRKFARNDNRITHTKIHTGEKPFQCRICMRKFARSDHLTQHTKIHLRGSGGGGSGGSGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKML

SEQ ID NO: 389 - protein, 350 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSQASNLISHIRTHTGEKPFACDICGRKFATSHSLTEHTKIHTGSQKPFQCRICMRNFSERSHLREHIRTHTGEKPFACDICGRKFAQSGNLTEHTKIHTGEKPFQCRICMRKFASKKALTEHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 390 - protein, 350 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSQASNLISHIRTHTGEKPFACDICGRKFAQRANLRAHTKIHTGSQKPFQCRICMRNFSQASNLISHIRTHTGEKPFACDICGRKFATSHSLTEHTKIHTGEKPFQCRICMRKFAERSHLREHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 391 - protein, 428 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSRSDNLSTHIRTHTGEKPFACDICGRKFADRSDLSRHTKIHTGEKPFQCRICMRKFAQSGDLTRHTKIHTGSQKPFQCRICMRNFSRSDSLSAHIRTHTGEKPFACDICGRKFAQKATRITHTKIHLRGSGGGGSGGSGGSGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGSGGSTNLSDIIEKETGKQLVIQESILMLPEEVEEVIGNKPESDILVHTAYDESTDENVMLLTSDAPEYKPWALVIQDSNGENKIKML

SEQ ID NO: 392 - protein, 350 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSQSSSLVRHIRTHTGEKPFACDICGRKFARSDNLVRHTKIHTGSQKPFQCRICMRNFSQAGHLASHIRTHTGEKPFACDICGRKFARKDNLKNHTKIHTGEKPFQCRICMRKFARKDALRGHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 393 - protein, 350 aa, Artificial Sequence
  Synthetic
MLGFVGRVAAAPASGALRRLTPSASLPPAQLLLRAAPTAVHPVRDYAAQDYKDDDDKVDEMTKKFGTLTIHDTEKAAMAERPFQCRICMRNFSRSDHLTTHIRTHTGEKPFACDICGRKFAQSSSLVRHTKIHTGSQKPFQCRICMRNFSRSDNLVRHIRTHTGEKPFACDICGRKFAQAGHLASHTKIHTGEKPFQCRICMRKFARKDNLKNHTKIHLRGSGGGGSGGSGGSAIPVKRGATGETKVFTGNSNSPKSPTKGGCSGGSTNLSDIIEKETGKQLVIQESILMLPEEVEEVIGNKPESDILVHTAYDESTDENVMLLTSDAPEYKPWALVIQDSNGENKIKML

SEQ ID NO: 394 - protein, 49 aa, Artificial Sequence
  Synthetic
MLGFVGRVAAAPASGALRRLTPSASLPPAQLLLRAAPTAVHPVRDYAAQ

SEQ ID NO: 395 - protein, 8 aa, Artificial Sequence
  Synthetic
DYKDDDDK

SEQ ID NO: 396 - protein, 18 aa, Artificial Sequence
  Synthetic
VDEMTKKFGTLTIHDTEK

SEQ ID NO: 397 - protein, 11 aa, Artificial Sequence
  Synthetic
LQKKLEELELD

SEQ ID NO: 398 - protein, 143 aa, Artificial Sequence
  Synthetic
MAERPFQCDICMRNFSTSGSLSRHIRTHTGEKPFQCDICMRNFSQSGSLTRHIRTHTGSEKPFQCDICMRNFSRSDALSQHIRTHTGEKPFQCDICMRNFSRNDNRITHIRTHTGEKPFQCDICMRNFSRSDHLTQHTKIHLR

SEQ ID NO: 399 - protein, 13 aa, Artificial Sequence
  Synthetic
GSGGGGSGGSGGS

SEQ ID NO: 400 - protein, 19 aa, Artificial Sequence
  Synthetic
ATNFSLLKQAGDVEENPGP

SEQ ID NO: 401 - protein, 30 aa, Artificial Sequence
  Synthetic
MASVLTPLLLRGLTGSARRLPVPRAKIHSL

SEQ ID NO: 402 - protein, 143 aa, Artificial Sequence
  Synthetic
MAERPFQCDICMRNFSQASNLISHIRTHTGEKPFQCDICMRNFSTSHSLTEHIRTHTGSEKPFQCDICMRNFSERSHLREHIRTHTGEKPFQCDICMRNFSQSGNLTEHIRTHTGEKPFQCDICMRNFSSKKALTEHTKIHLR

SEQ ID NO: 403 - protein, 143 aa, Artificial Sequence
  Synthetic
MAERPFQCDICMRNFSQASNLISHIRTHTGEKPFQCDICMRNFSQRANLRAHIRTHTGSEKPFQCDICMRNFSQASNLISHIRTHTGEKPFQCDICMRNFSTSHSLTEHIRTHTGEKPFQCDICMRNFSERSHLREHTKIHLR

SEQ ID NO: 404 - protein, 143 aa, Artificial Sequence
  Synthetic
MAERPFQCDICMRNFSRSDNLSTHIRTHTGEKPFQCDICMRNFSDRSDLSRHIRTHTGEKPFQCDICMRNFSQSGDLTRHIRTHTGSEKPFQCDICMRNFSRSDSLSAHIRTHTGEKPFQCDICMRNFSQKATRITHTKIHLR

SEQ ID NO: 405 - protein, 143 aa, Artificial Sequence
  Synthetic
MAERPFQCDICMRNFSQSSSLVRHIRTHTGEKPFQCDICMRNFSRSDNLVRHIRTHTGSEKPFQCDICMRNFSQAGHLASHIRTHTGEKPFQCDICMRNFSRKDNLKNHIRTHTGEKPFQCDICMRNFSRKDALRGHTKIHLR

SEQ ID NO: 406 - protein, 143 aa, Artificial Sequence
  Synthetic
MAERPFQCDICMRNFSRSDHLTTHIRTHTGEKPFQCDICMRNFSQSSSLVRHIRTHTGSEKPFQCDICMRNFSRSDNLVRHIRTHTGEKPFQCDICMRNFSQAGHLASHIRTHTGEKPFQCDICMRNFSRKDNLKNHTKIHLR

SEQ ID NO: 407 - protein, 143 aa, Artificial Sequence
  Synthetic
MAERPFQCRICMRNFSTSGSLSRHIRTHTGEKPFACDICGRKFAQSGSLTRHTKIHTGGQRPFQCRICMRNFSRSDALSQHIRTHTGEKPFACDICGRKFARNDNRITHTKIHTGEKPFQCRICMRKFARSDHLTQHTKIHLR

SEQ ID NO: 408 - protein, 143 aa, Artificial Sequence
  Synthetic
MAERPFQCRICMRNFSQASNLISHIRTHTGEKPFACDICGRKFATSHSLTEHTKIHTGSQKPFQCRICMRNFSERSHLREHIRTHTGEKPFACDICGRKFAQSGNLTEHTKIHTGEKPFQCRICMRKFASKKALTEHTKIHLR

SEQ ID NO: 409 - protein, 143 aa, Artificial Sequence
  Synthetic
MAERPFQCRICMRNFSQASNLISHIRTHTGEKPFACDICGRKFAQRANLRAHTKIHTGSQKPFQCRICMRNFSQASNLISHIRTHTGEKPFACDICGRKFATSHSLTEHTKIHTGEKPFQCRICMRKFAERSHLREHTKIHLR

SEQ ID NO: 410 - protein, 143 aa, Artificial Sequence
  Synthetic
MAERPFQCRICMRNFSRSDNLSTHIRTHTGEKPFACDICGRKFADRSDLSRHTKIHTGEKPFQCRICMRKFAQSGDLTRHTKIHTGSQKPFQCRICMRNFSRSDSLSAHIRTHTGEKPFACDICGRKFAQKATRITHTKIHLR

SEQ ID NO: 411 - protein, 143 aa, Artificial Sequence
  Synthetic
MAERPFQCRICMRNFSQSSSLVRHIRTHTGEKPFACDICGRKFARSDNLVRHTKIHTGSQKPFQCRICMRNFSQAGHLASHIRTHTGEKPFACDICGRKFARKDNLKNHTKIHTGEKPFQCRICMRKFARKDALRGHTKIHLR

SEQ ID NO: 412 - protein, 143 aa, Artificial Sequence
  Synthetic
MAERPFQCRICMRNFSRSDHLTTHIRTHTGEKPFACDICGRKFAQSSSLVRHTKIHTGSQKPFQCRICMRNFSRSDNLVRHIRTHTGEKPFACDICGRKFAQAGHLASHTKIHTGEKPFQCRICMRKFARKDNLKNHTKIHLR

SEQ ID NO: 413 - protein, 178 aa, Artificial Sequence
  Synthetic
  misc_feature (1)..(1): Xaa can be any naturally occurring amino acid
  misc_feature (105)..(105): Xaa can be any naturally occurring amino acid
  misc_feature (130)..(130): Xaa can be any naturally occurring amino acid
  misc_feature (141)..(141): Xaa can be any naturally occurring amino acid
XGSSHHHHHHSQDPIGLNGGANVYHYAPNPVGWVDPWGLAGSYALGPYQISAPQLPAYNGQTVGTFYYVNDAGGLESKVFSSGGPTPYPNYANAGHVEGQSALFXRDNGISEGLVFHNNPEGTCGFCVNXTETLLPENAKXTVVPPEGAIPVKRGATGETKVFTGNSNSPKSPTKGGC

SEQ ID NO: 414 - protein, 202 aa, Artificial Sequence
  Synthetic
MPDFTIIQPDRKFDAAAVAGIFVRSSTSSSFPSASSYIAAKKRKNVDNTSTRKPYSYKDRKRKNTEEIRNIKKKLFMDLGIVRTNCGIDNEKQDREKAMKRKVTETIVTTYCELCEQNFSSSKMLLLHRGKVHNTPYIECHLCMKLFSQTIQFNRHMKTHYGPNAKIYVQCELCDRQFKDKQSLRTHWDVSHGSGDNQAVLA

SEQ ID NO: 415 - protein, 1068 aa, Artificial Sequence
  Synthetic
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 416 - protein, 1169 aa, Artificial Sequence
  Synthetic
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 417 - protein, 1089 aa, Artificial Sequence
  Synthetic
MGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 418 - protein, 574 aa, Artificial Sequence
  Synthetic
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 419 - protein, 898 aa, Artificial Sequence
  Synthetic
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 420 - protein, 799 aa, Artificial Sequence
  Synthetic
SVLTPLLLRGLTGSARRLPVPRAKIHSLMGSYALGPYQISAPQLPAYNGQTVGTFYYVNDAGGLESKVFSSGGPTPYPNYANAGHVEGQSALFMRDNGISEGLVFHNNPEGTCGFCVNMTETLLPENAKMTVVPPEGGSDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQALLPVLCQAHGLTPQQVVAIASNIGGKQALETVQRLLPVLCQAHGLTPQQVVAIASNNGGKQALETVQRLLPVLCQAHGLTPEQVVAIASNNGGKQALETVQALLPVLCQAHGLTPEQVVAIASNNGGKQALETVQALLPVLCQAHGLTPEQVVAIASNGGGKQALETVQALLPVLCQAHGLTPEQVVAIASNNGGKQALETVQRLLPVLCQAHGLTPEQVVAIASNIGGKQALETVQALLPVLCQAHGLTPEQVVAIASNNGGKQALETVQRLLPVLCQAHGLTPEQVVAIASHDGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGSGGSTNLSDIIEKETGKQLVIQESILMLPEEVEEVIGNKPESDILVHTAYDESTDENVMLLTSDAPEYKPWALVIQDSNGENKIKML

SEQ ID NO: 421 - protein, 5 aa, Artificial Sequence
  Synthetic
MAERP

SEQ ID NO: 422 - protein, 7 aa, Artificial Sequence
  Synthetic
HTKIHLR

SEQ ID NO: 423 - protein, 11 aa, Artificial Sequence
  Synthetic
FQCRICMRNFS

SEQ ID NO: 424 - protein, 11 aa, Artificial Sequence
  Synthetic
FACDICGRKFA

SEQ ID NO: 425 - protein, 11 aa, Artificial Sequence
  Synthetic
FQCRICMRKFA

SEQ ID NO: 426 - protein, 5 aa, Artificial Sequence
  Synthetic
HIRTH

SEQ ID NO: 427 - protein, 5 aa, Artificial Sequence
  Synthetic
HTKIH

SEQ ID NO: 428 - protein, 5 aa, Artificial Sequence
  Synthetic
TGEKP

SEQ ID NO: 429 - protein, 5 aa, Artificial Sequence
  Synthetic
TGQKP

SEQ ID NO: 430 - protein, 6 aa, Artificial Sequence
  Synthetic
TGSQKP

SEQ ID NO: 431 - protein, 28 aa, Artificial Sequence
  Synthetic
  misc_feature (12)..(18): Xaa can be any naturally occurring amino acid
FQCRICMRNFSXXXXXXXHIRTHTGEKP

SEQ ID NO: 432 - protein, 29 aa, Artificial Sequence
  Synthetic
  misc_feature (12)..(18): Xaa can be any naturally occurring amino acid
FACDICGRKFAXXXXXXXHTKIHTGSQKP

SEQ ID NO: 433 - protein, 28 aa, Artificial Sequence
  Synthetic
  misc_feature (12)..(18): Xaa can be any naturally occurring amino acid
FACDICGRKFAXXXXXXXHTKIHTGEKP

SEQ ID NO: 434 - protein, 25 aa, Artificial Sequence
  Synthetic
  misc_feature (12)..(18): Xaa can be any naturally occurring amino acid
FQCRICMRKFAXXXXXXXHTKIHLR

SEQ ID NO: 435 - protein, 6 aa, Artificial Sequence
  Synthetic
TGSEKP

SEQ ID NO: 436 - protein, 29 aa, Artificial Sequence
  Synthetic
  misc_feature (12)..(18): Xaa can be any naturally occurring amino acid
FQCRICMRNFSXXXXXXXHIRTHTGSEKP

SEQ ID NO: 437 - protein, 25 aa, Artificial Sequence
  Synthetic
  misc_feature (12)..(18): Xaa can be any naturally occurring amino acid
FQCRICMRNFSXXXXXXXHTKIHLR

SEQ ID NO: 438 - protein, 11 aa, Artificial Sequence
  Synthetic
FQCDICMRNFS

SEQ ID NO: 439 - protein, 37 aa, Artificial Sequence
  Synthetic
DGNEHWEVHPGLSLSDFEVVYGNNPHQIVKLRLDKEV

SEQ ID NO: 440 - protein, 6 aa, Artificial Sequence
  Synthetic
GGSGGS

SEQ ID NO: 441 - protein, 19 aa, Artificial Sequence
  Synthetic
MVQNDFIDSYTLCWLLRDD

SEQ ID NO: 442 - protein, 6 aa, Artificial Sequence
  Synthetic
SGGGGS

SEQ ID NO: 443 - protein, 56 aa, Artificial Sequence
  Synthetic
MVQNDFIDSYTLCWLLRDDDGNEHWEVHPGLSLSDFEVVYGNNPHQIVKLRLDKEV

SEQ ID NO: 444 - protein, 1346 aa, Enterococcus cecorum
MNKYYLGLDMGSASVGWAVTDENYHLVRRKGKDLWGVRTFDVAQTAKERRITRGNRRRQDRRKQRIQILQELLGEEVLKTDPGFFHRMKESRYVVEDKRTLDGKQVELPYALFVDKDYTDKEYYKQFPTINHLIVYLMTTSDTPDIRLVYLALHYYMKNRGNFLHSGDINNVKDINDILEQLDNVLETFLDGWNLKLKSYVEDIKNIYNRDLGRGERKKAFVNTLGAKTKAEKAFCSLISGGSTNLAELFDDSSLKEIETPKIEFASSSLEDKIDGIQEALEDRFAVIEAAKRLYDWKTLTDILGDSSSLAEARVNSYQMHHEQLLELKSLVKEYLDRKVFQEVFVSLNVANNYPAYIGHTKINGKKKELEVKRTKRNDFYSYVKKQVIEPIKKKVSDEAVLTKLSEIESLIEVDKYLPLQVNSDNGVIPYQVKLNELTRIFDNLENRIPVLRENRDKIIKTFKFRIPYYVGSLNGVVKNGKCTNWMVRKEEGKIYPWNFEDKVDLEASAEQFIRRMTNKCTYLVNEDVLPKYSLLYSKYLVLSELNNLRIDGRPLDVKIKQDIYENVFKKNRKVTLKKIKKYLLKEGIITDDDALSGLADDVKSSLTAYRDFKEKLGHLDLSEAQMENIILNITLFGDDKKLLKKRLAALYPFIDDKSLNRIATLNYRDWGRLSERFLSGITSVDQETGELRTIIQCMYETQANLMQLLAEPYHFVEAIEKENPKVDLESISYRIVNDLYVSPAVKRQIWQTLLVIKDIKQVMKHDPERIFIEMAREKQESKKTKSRKQVLSEVYKKAKEYEHLFEKLNSLTEEQLRSKKIYLYFTQLGKCMYSGEPIDFENLVSANSNYDIDHIYPQSKTIDDSFNNIVLVKKSLNAYKSNHYPIDKNIRDNEKVKTLWNTLVSKGLITKEKYERLIRSTPFSDEELAGFIARQLVETRQSTKAVAEILSNWFPESEIVYSKAKNVSNFRQDFEILKVRELNDCHHAHDAYLNIVVGNAYHTKFTNSPYRFIKNKANQEYNLRKLLQKVNKIESNGVVAWVGQSENNPGTIATVKKVIRRNTVLISRMVKEVDGQLFDLTLMKKGKGQVPIKSSDERLTDISKYGGYNKATGAYFTFVKSKKRGKVVRSFEYVPLHLSKQFENNNELLKEYIEKDRGLTDVEILIPKVLINSLFRYNGSLVRITGRGDTRLLLVHEQPLYVSNSFVQQLKSVSSYKLKKSENDNAKLTKTATEKLSNIDELYDGLLRKLDLPIYSYWFSSIKEYLVESRTKYIKLSIEEKALVIFEILHLFQSDAQVPNLKILGLSTKPSRIRIQKNLKDTDKMSIIHQSPSGIFEHEIELTSL

SEQ ID NO: 445 - protein, 112 aa, Artificial Sequence
  Synthetic
MTLELQLKHYITNLFNLPKDEKWHCESIEEIADDILPDQYVRLGALSNKILQTYTYYSDTLHESNIYPFILYYQKQLIAIGYIDENHDMDFLYLHNTIMPLLDQRYLLTGGQ

SEQ ID NO: 446 - protein, 130 aa, Artificial Sequence
  Synthetic
MNKNFDEVKADLRTVTGKKIEFKERLKNILRVQMNQLGFEDSYMIQVQVSSDQEEWVECHENMSLSDFEVMYGNISGEIKRMTVVKYEEANIEKLVELKFEYEYAKAHQEYIRAYTKLMSNTLYGRKPSL

SEQ ID NO: 447 - protein, 124 aa, Artificial Sequence
  Synthetic
MNEEKMHYRDAIKEVELTMMSLDSHFRTHKEFTDSYLLVLILEDVVGETRVEVSEGLTFDEASYIIGGTSDNILNMHMINYCEKNREEIYKWLKVSRVNTFKSNYAKMLLNTAYGKDLLKGVVK

SEQ ID NO: 448 - DNA, 20 bp, Artificial Sequence
  Synthetic
ccctccctccctggcccagg

SEQ ID NO: 449 - DNA, 40 bp, Artificial Sequence
  Synthetic
tcatctgtgcccctccctccctggcccaggtgaaggtgtg

SEQ ID NO: 450 - DNA, 40 bp, Artificial Sequence
  Synthetic
tcatctgtgcccctccctttctggcccaggtgaaggtgtg

SEQ ID NO: 451 - DNA, 40 bp, Artificial Sequence
  Synthetic
tcatctgtgcccctccctttttggcccaggtgaaggtgtg

SEQ ID NO: 452 - DNA, 40 bp, Artificial Sequence
  Synthetic
tcatctgtgcccctccctccctaacccaggtgaaggtgtg

SEQ ID NO: 453 - DNA, 40 bp, Artificial Sequence
  Synthetic
tcatctgtgcccctcccttcctggcccaggtgaaggtgtg

SEQ ID NO: 454 - DNA, 40 bp, Artificial Sequence
  Synthetic
tcatctgtgcccctccctccctagcccaggtgaaggtgtg

SEQ ID NO: 455 - DNA, 40 bp, Artificial Sequence
  Synthetic
tcatctgtgcccctttctttctggcccaggtgaaggtgtg

SEQ ID NO: 456 - DNA, 40 bp, Artificial Sequence
  Synthetic
tcatctgtgcccctccctccctggcccaggtaaaggtgtg

SEQ ID NO: 457 - DNA, 40 bp, Artificial Sequence
  Synthetic
tcatctgtgccccttcctttctggcccaggtgaaggtgtg

SEQ ID NO: 458 - DNA, 40 bp, Artificial Sequence
  Synthetic
tcatctgtgcccctccctctctggcccaggtgaaggtgtg

SEQ ID NO: 459 - DNA, 40 bp, Artificial Sequence
  Synthetic
tcatctgtgcccctttctttttggcccaggtgaaggtgtg

SEQ ID NO: 460 - DNA, 40 bp, Artificial Sequence
  Synthetic
tcatctgtgcccctttctccctggcccaggtgaaggtgtg

SEQ ID NO: 461 - DNA, 40 bp, Artificial Sequence
  Synthetic
tcatctgtgcccctccctttctaacccaggtgaaggtgtg

SEQ ID NO: 462 - DNA, 48 bp, Artificial Sequence
  Synthetic
gtgcccctccctccctggcccaggtgaaggtgtggttccagaaccgga

SEQ ID NO: 463 - DNA, 25 bp, Artificial Sequence
  Synthetic
ctgagtttctcatctgtgcccctcc

SEQ ID NO: 464 - DNA, 47 bp, Artificial Sequence
  Synthetic
cccctgacccccatgcctcaggatactcctcaatagccatcgctgta

SEQ ID NO: 465 - DNA, 47 bp, Artificial Sequence
  Synthetic
atgtccgatggctattgaggagtatcctgaggcatgggggtcagggg

SEQ ID NO: 466 - DNA, 38 bp, Artificial Sequence
  Synthetic
tgacccccatgcctcaggatactcctcaatagccatcg

SEQ ID NO: 467 - DNA, 38 bp, Artificial Sequence
  Synthetic
cgatggctattgaggagtatcctgaggcatgggggtca

SEQ ID NO: 468 - DNA, 15 bp, Artificial Sequence
  Synthetic
cctcaggatactcct

SEQ ID NO: 469 - DNA, 50 bp, Artificial Sequence
  Synthetic
aacccctgacccccatgcctcaggatactcctcaatagccatcgctgtag

SEQ ID NO: 470 - protein, 17 aa, Artificial Sequence
  Synthetic
VGSGWAEPYEEIAMATT

SEQ ID NO: 471 - DNA, 50 bp, Artificial Sequence
  Synthetic
ctacagcgatggctattgaggagtatcctgaggcatgggggtcaggggtt

SEQ ID NO: 472 - DNA, 54 bp, Artificial Sequence
  Synthetic
agcctagcattagcaggaatacctttcctcacaggtttctactccaaaaaccac

SEQ ID NO: 473 - DNA, 54 bp, Artificial Sequence
  Synthetic
gtggtttttggagtagaaacctgtgaggaaaggtattcctgctaatgctaggct

SEQ ID NO: 474 - DNA, 54 bp, Artificial Sequence
  Synthetic
agcctagcattagcaggaatacctttcctcacaggtttctactccaaagaccac

SEQ ID NO: 475 - DNA, 54 bp, Artificial Sequence
  Synthetic
gtggtctttggagtagaaacctgtgaggaaaggtattcctgctaatgctaggct

SEQ ID NO: 476 - DNA, 16 bp, Artificial Sequence
  Synthetic
tagcattagcaggaat

SEQ ID NO: 477 - DNA, 16 bp, Artificial Sequence
  Synthetic
aactttcctcacaggt

SEQ ID NO: 478 - DNA, 52 bp, Artificial Sequence
  Synthetic
aaaatattaaacacaaactaccacctacctccctcaccaaagcccataaaaa

SEQ ID NO: 479 - DNA, 52 bp, Artificial Sequence
  Synthetic
tttttatgggctttggtgagggaggtaggtggtagtttgtgtttaatatttt

SEQ ID NO: 480 - DNA, 17 bp, Artificial Sequence
  Synthetic
tattaaacacaaactat

SEQ ID NO: 481 - DNA, 15 bp, Artificial Sequence
  Synthetic
ccacctacctccctc

SEQ ID NO: 482 - DNA, 17 bp, Artificial Sequence
  Synthetic
ctgagtttctcatctgt

SEQ ID NO: 483 - DNA, 17 bp, Artificial Sequence
  Synthetic
acagatgagaaactcag

SEQ ID NO: 484 - DNA, 23 bp, Artificial Sequence
  Synthetic
ctgagtttctcatctgtgcccct

SEQ ID NO: 485 - DNA, 23 bp, Artificial Sequence
  Synthetic
aggggcacagatgagaaactcag

SEQ ID NO: 486 - DNA, 44 bp, Artificial Sequence
  Synthetic
ctgagtttctcatctgtgcccctccctccctggcccaggtgaag

SEQ ID NO: 487 - DNA, 44 bp, Artificial Sequence
  Synthetic
cttcacctgggccagggagggaggggcacagatgagaaactcag

SEQ ID NO: 488 - DNA, 11 bp, Artificial Sequence
  Synthetic
tgacccccatt

SEQ ID NO: 489 - DNA, 38 bp, Artificial Sequence
  Synthetic
tgacccccattcctcaggatactcctaaatagccatcg

SEQ ID NO: 490 - DNA, 16 bp, Artificial Sequence
  Synthetic
cctcaggatactcctc

SEQ ID NO: 491 - DNA, 16 bp, Artificial Sequence
  Synthetic
cctcaaaatactcctc

SEQ ID NO: 492 - DNA, 16 bp, Artificial Sequence
  Synthetic
cctcaaaatacttctc

SEQ ID NO: 493 - DNA, 16 bp, Artificial Sequence
  Synthetic
cctcagaatactcctc

SEQ ID NO: 494 - DNA, 16 bp, Artificial Sequence
  Synthetic
cctcaaaatatttctc

SEQ ID NO: 495 - DNA, 16 bp, Artificial Sequence
  Synthetic
cctcaggatacttctc

SEQ ID NO: 496 - DNA, 16 bp, Artificial Sequence
  Synthetic
cctcaaaatattcctc

SEQ ID NO: 497 - DNA, 16 bp, Artificial Sequence
  Synthetic
cctcagaatacttctc

SEQ ID NO: 498 - DNA, 16 bp, Artificial Sequence
  Synthetic
cctcaggatatttctc

SEQ ID NO: 499 - DNA, 15 bp, Artificial Sequence
  Synthetic
tctagcctagccgtt

SEQ ID NO: 500 - DNA, 19 bp, Artificial Sequence
  Synthetic
tgagtttgatgctcaccct

SEQ ID NO: 501 - DNA, 13 bp, Artificial Sequence
  Synthetic
actcaatcctctg

SEQ ID NO: 502 - DNA, 16 bp, Artificial Sequence
  Synthetic
gatcagaggattgagt

SEQ ID NO: 503 - DNA, 16 bp, Artificial Sequence
  Synthetic
acctttcctcacaggt

SEQ ID NO: 504 - DNA, 14 bp, Artificial Sequence
  Synthetic
tctttggagtagaa

SEQ ID NO: 505 - DNA, 16 bp, Artificial Sequence
  Synthetic
acctgtgaggaaaggt

SEQ ID NO: 506 - DNA, 18 bp, Artificial Sequence
  Synthetic
tgctagtaaccacgttct

SEQ ID NO: 507 - DNA, 14 bp, Artificial Sequence
  Synthetic
cctgatcaaatatc

SEQ ID NO: 508 - DNA, 18 bp, Artificial Sequence
  Synthetic
tcctgtaagtaggagagt

SEQ ID NO: 509 - DNA, 14 bp, Artificial Sequence
  Synthetic
gatatttgatcagg

SEQ ID NO: 510 - DNA, 16 bp, Artificial Sequence
  Synthetic
tcaaaaccatacctct

SEQ ID NO: 511 - DNA, 18 bp, Artificial Sequence
  Synthetic
cacttcaacctccctcac

SEQ ID NO: 512 - DNA, 17 bp, Artificial Sequence
  Synthetic
tgctaggctgccaatgt

SEQ ID NO: 513 - DNA, 18 bp, Artificial Sequence
  Synthetic
gtgagggaggttgaagtg

SEQ ID NO: 514 - DNA, 16 bp, Artificial Sequence
  Synthetic
tcagttcttcaaatat

SEQ ID NO: 515 - DNA, 18 bp, Artificial Sequence
  Synthetic
ctactcatcttcctaatt

SEQ ID NO: 516 - DNA, 15 bp, Artificial Sequence
  Synthetic
taagattagtatggt

SEQ ID NO: 517 - DNA, 12 bp, Artificial Sequence
  Synthetic
aattaggaagat

SEQ ID NO: 518 - DNA, 13 bp, Artificial Sequence
  Synthetic
tatgggctttggt

SEQ ID NO: 519 - DNA, 15 bp, Artificial Sequence
  Synthetic
gagggaggtaggtgg

SEQ ID NO: 520 - DNA, 19 bp, Artificial Sequence
  Synthetic
tcttagcatactcctcaat

SEQ ID NO: 521 - DNA, 15 bp, Artificial Sequence
  Synthetic
taccaccataggatg

SEQ ID NO: 522 - DNA, 16 bp, Artificial Sequence
  Synthetic
tagaactgctattatt

SEQ ID NO: 523 - DNA, 15 bp, Artificial Sequence
  Synthetic
catcctatgtgggta

SEQ ID NO: 524 - DNA, 13 bp, Artificial Sequence
  Synthetic
tctcctgatcaaa

SEQ ID NO: 525 - DNA, 36 bp, Artificial Sequence
  Synthetic
tttttttttttttttggcgagttttttttttttttt

SEQ ID NO: 526 - DNA, 36 bp, Artificial Sequence
  Synthetic
  misc_feature (18)..(18): n is a, c, g, or t
aaaaaaaaaaaaaaaggncggaaaaaaaaaaaaaaa

SEQ ID NO: 527 - DNA, 12 bp, Artificial Sequence
  Synthetic
ctgagtttctca

SEQ ID NO: 528 - DNA, 28 bp, Artificial Sequence
  Synthetic
ctgctctgggggcctcctgagtttctca

SEQ ID NO: 529 - DNA, 33 bp, Artificial Sequence
  Synthetic
ctgctctgggggcctcctgagtttctcatctgt

SEQ ID NO: 530 - DNA, 39 bp, Artificial Sequence
  Synthetic
ctgctctgggggcctcctgagtttctcatctgtgcccct

SEQ ID NO: 531 - DNA, 60 bp, Artificial Sequence
  Synthetic
ctgctctgggggcctcctgagtttctcatctgtgcccctccctccctggcccaggtgaag

SEQ ID NO: 532 - DNA, 54 bp, Artificial Sequence
  Synthetic
ttcattacacctgcagctctcattttccatacagtcagtatcaattctggaaga

SEQ ID NO: 533 - DNA, 54 bp, Artificial Sequence
  Synthetic
tcttccagaattgatactgactgtatggaaaatgagagctgcaggtgtaatgaa

SEQ ID NO: 534 - DNA, 18 bp, Artificial Sequence
  Synthetic
ttcattacacctgcagct

SEQ ID NO: 535 - DNA, 18 bp, Artificial Sequence
  Synthetic
ctcattttccatacagtc

SEQ ID NO: 536 - DNA, 18 bp, Artificial Sequence
  Synthetic
tcttccagaattgatact

SEQ ID NO: 537 - DNA, 18 bp, Artificial Sequence
  Synthetic
gactgtatggaaaatgag

SEQ ID NO: 538 - DNA, 12 bp, Artificial Sequence
  Synthetic
cgatggctattt

SEQ ID NO: 539 - DNA, 38 bp, Artificial Sequence
  Synthetic
cgatggctatttaggagtatcctgaggaatgggggtca

SEQ ID NO: 540 - DNA, 13 bp, Artificial Sequence
  Synthetic
tttcctcacaggt

SEQ ID NO: 541 - DNA, 13 bp, Artificial Sequence
  Synthetic
tcaggatactcct

SEQ ID NO: 542 - DNA, 13 bp, Artificial Sequence
  Synthetic
caacctccctcac

SEQ ID NO: 543 - DNA, 13 bp, Artificial Sequence
  Synthetic
catcttcctaatt

SEQ ID NO: 544 - DNA, 12 bp, Artificial Sequence
  Synthetic
acccacatagga

SEQ ID NO: 545 - DNA, 14 bp, Artificial Sequence
  Synthetic
ctcaatcctctgat

SEQ ID NO: 546 - DNA, 12 bp, Artificial Sequence
  Synthetic
cctacctccctc

SEQ ID NO: 547 - DNA, 60 bp, Artificial Sequence
  Synthetic
tctcatctgtgcccctccctccctggcccaggtgaaggtgtggttccagaaccggaggac

SEQ ID NO: 548 - DNA, 60 bp, Artificial Sequence
  Synthetic
gtcctccggttctggaaccacaccttcacctgggccagggagggaggggcacagatgaga

SEQ ID NO: 549 - DNA, 111 bp, Artificial Sequence
  Synthetic
cctgagtgttgaggccccagtggctgctctgggggcctcctgagtttctcatctgtgcccctccctccctggcccaggtgaaggtgtggttccagaaccggaggacaaagt

SEQ ID NO: 550 - DNA, 23 bp, Artificial Sequence
  Synthetic
ggactcacaactccggggtcacc

SEQ ID NO: 551 - DNA, 23 bp, Artificial Sequence
  Synthetic
ggtcaccgacgagacccccggag

SEQ ID NO: 552 - DNA, 28 bp, Artificial Sequence
  Synthetic
tctgtgcccctccctccctggcccaggt

SEQ ID NO: 553 - DNA, 29 bp, Artificial Sequence
  Synthetic
gcccctccctccctggcccaggtgaaggt

SEQ ID NO: 554 - DNA, 28 bp, Artificial Sequence
  Synthetic
ccctccctggcccaggtgaaggtgtggt

SEQ ID NO: 555 - DNA, 28 bp, Artificial Sequence
  Synthetic
gtgtggttccagaaccggaggacaaagt

SEQ ID NO: 556 - protein, 91 aa, Artificial Sequence
  Synthetic
MNNHFMSIGRNCSKCNNVRLNEDFSKSEEICNECFDKEERFVDSYTLIYITEDETGKRFEAILENQTIEETEIIYGNIIDKIIVWNVILTM

SEQ ID NO: 557 - DNA, 103 bp, Artificial Sequence
  Synthetic
tgagtgttgaggccccagtggctgctctgggggcctcctgagtttctcatctgtgcccctccctccctggcccaggtgaaggtgtggttccagaaccggagga

SEQ ID NO: 558 - DNA, 104 bp, Artificial Sequence
  Synthetic
ctgagtgttgaggccccagtggctgctctgggggcctcctgagtttctcatctgtgcccctccctccctggcccaggtgaaggtgtggttccagaaccggagga

SEQ ID NO: 559 - DNA, 15 bp, Artificial Sequence
  Synthetic
aggagtatcctgagg

SEQ ID NO: 560 - DNA, 38 bp, Artificial Sequence
  Synthetic
tgacccccatgcctcaggatactcctcaatagccaccg

SEQ ID NO: 561 - DNA, 38 bp, Artificial Sequence
  Synthetic
cggtggctattgaggagtatcctgaggcatgggggtca

SEQ ID NO: 562 - DNA, 46 bp, Artificial Sequence
  Synthetic
tagcattagcaggaatacctttcctcacaggtttctactccaaaga

SEQ ID NO: 563 - DNA, 46 bp, Artificial Sequence
  Synthetic
tctttggagtagaaacctgtgaggaaaggtattcctgctaatgcta

SEQ ID NO: 564 - DNA, 46 bp, Artificial Sequence
  Synthetic
tagcattggcaggaatacccttcctcacaggtttctactccaaaga

SEQ ID NO: 565 - DNA, 46 bp, Artificial Sequence
  Synthetic
tctttggagtagaaacctgtgaggaagggtattcctgccaatgcta

SEQ ID NO: 566 - DNA, 50 bp, Artificial Sequence
  Synthetic
tgctagtaaccacgttctcctgatcaaatatcactctcctacttacagga

SEQ ID NO: 567 - DNA, 50 bp, Artificial Sequence
  Synthetic
tcctgtaagtaggagagtgatatttgatcaggagaacgtggttactagca

SEQ ID NO: 568 - DNA, 50 bp, Artificial Sequence
  Synthetic
tgctagtaaccacattctcctgatcaaatatcactctcctacttacagga

SEQ ID NO: 569 - DNA, 50 bp, Artificial Sequence
  Synthetic
tcctgtaagtaggagagtgatatttgatcaggagaatgtggttactagca

SEQ ID NO: 570 - DNA, 13 bp, Artificial Sequence
  Synthetic
ttagtagaacgca

SEQ ID NO: 571 - DNA, 13 bp, Artificial Sequence
  Synthetic
cattctgactccc

SEQ ID NO: 572 - DNA, 13 bp, Artificial Sequence
  Synthetic
ttggatgatggta

SEQ ID NO: 573 - DNA, 16 bp, Artificial Sequence
  Synthetic
actcaatcctctgatc

SEQ ID NO: 574 - protein, 7 aa, Artificial Sequence
  Synthetic
RKDALRG

SEQ ID NO: 575 - protein, 7 aa, Artificial Sequence
  Synthetic
TTGALTE

SEQ ID NO: 576 - protein, 7 aa, Artificial Sequence
  Synthetic
QRHHLVE

SEQ ID NO: 577 - protein, 7 aa, Artificial Sequence
  Synthetic
QNSTLTE

SEQ ID NO: 578 - protein, 7 aa, Artificial Sequence
  Synthetic
RNDALTE

SEQ ID NO: 579 - protein, 7 aa, Artificial Sequence
  Synthetic
HKNALQN

SEQ ID NO: 580 - protein, 7 aa, Artificial Sequence
  Synthetic
RRSACRR

SEQ ID NO: 581 - protein, 7 aa, Artificial Sequence
  Synthetic
QKSSLIA

SEQ ID NO: 582 - protein, 7 aa, Artificial Sequence
  Synthetic
RRDELNV

SEQ ID NO: 583 - protein, 7 aa, Artificial Sequence
  Synthetic
TSGSLVR

SEQ ID NO: 584 - protein, 7 aa, Artificial Sequence
  Synthetic
DPGALVR

SEQ ID NO: 585 - protein, 7 aa, Artificial Sequence
  Synthetic
QSSSLVR

SEQ ID NO: 586 - protein, 7 aa, Artificial Sequence
  Synthetic
RSDELVR

SEQ ID NO: 587 - protein, 7 aa, Artificial Sequence
  Synthetic
RLRDIQF

SEQ ID NO: 588 - protein, 7 aa, Artificial Sequence
  Synthetic
RSDERKR

SEQ ID NO: 589 - protein, 7 aa, Artificial Sequence
  Synthetic
RSDHLTT

SEQ ID NO: 590 - protein, 7 aa, Artificial Sequence
  Synthetic
RLRALDR

SEQ ID NO: 591 - protein, 7 aa, Artificial Sequence
  Synthetic
TKNSLTE

SEQ ID NO: 592 - protein, 7 aa, Artificial Sequence
  Synthetic
SKKHLAE

SEQ ID NO: 593 - protein, 7 aa, Artificial Sequence
  Synthetic
TSHSLTE

SEQ ID NO: 594 - protein, 7 aa, Artificial Sequence
  Synthetic
RNDTLTE

SEQ ID NO: 595 - protein, 7 aa, Artificial Sequence
  Synthetic
THLDLIR

SEQ ID NO: 596 - protein, 7 aa, Artificial Sequence
  Synthetic
DKKDLTR

SEQ ID NO: 597 - protein, 7 aa, Artificial Sequence
  Synthetic
SPADLTR

SEQ ID NO: 598 - protein, 7 aa, Artificial Sequence
  Synthetic
RTDTLRD

SEQ ID NO: 599 - protein, 7 aa, Artificial Sequence
  Synthetic
TSGELVR

SEQ ID NO: 600 - protein, 7 aa, Artificial Sequence
  Synthetic
DCRDLAR

SEQ ID NO: 601 - protein, 7 aa, Artificial Sequence
  Synthetic
QSGDLRR

SEQ ID NO: 602 - protein, 7 aa, Artificial Sequence
  Synthetic
RSDDLVR

SEQ ID NO: 603 - protein, 7 aa, Artificial Sequence
  Synthetic
ARGNLRT

SEQ ID NO: 604 - protein, 7 aa, Artificial Sequence
  Synthetic
SRGNLKS

SEQ ID NO: 605 - protein, 7 aa, Artificial Sequence
  Synthetic
QASNLIS

SEQ ID NO: 606 - protein, 7 aa, Artificial Sequence
  Synthetic
REDNLHT

SEQ ID NO: 607 - protein, 7 aa, Artificial Sequence
  Synthetic
TSGNLTE

SEQ ID NO: 608 - protein, 7 aa, Artificial Sequence
  Synthetic
SKKALTE

SEQ ID NO: 609 - protein, 7 aa, Artificial Sequence
  Synthetic
QSGNLTA

SEQ ID NO: 610 - protein, 7 aa, Artificial Sequence
  Synthetic
RADNLTE

SEQ ID NO: 611 - protein, 7 aa, Artificial Sequence
  Synthetic
TTGNLTV

SEQ ID NO: 612 - protein, 7 aa, Artificial Sequence
  Synthetic
DSGNLRV

SEQ ID NO: 613 - protein, 7 aa, Artificial Sequence
  Synthetic
QRANLRA

SEQ ID NO: 614 - protein, 7 aa, Artificial Sequence
  Synthetic
RKDNLKN

SEQ ID NO: 615 - protein, 7 aa, Artificial Sequence
  Synthetic
TSGNLVR

SEQ ID NO: 616 - protein, 7 aa, Artificial Sequence
  Synthetic
DPGNLVR

SEQ ID NO: 617 - protein, 7 aa, Artificial Sequence
  Synthetic
QSSNLVR

SEQ ID NO: 618 - protein, 7 aa, Artificial Sequence
  Synthetic
RSDNLVR

SEQ ID NO: 619 - protein, 7 aa, Artificial Sequence
  Synthetic
APKALGW

SEQ ID NO: 620 - protein, 7 aa, Artificial Sequence
  Synthetic
QAGHLAS

SEQ ID NO: 621 - protein, 7 aa, Artificial Sequence
  Synthetic
SRRTCRA

SEQ ID NO: 622 - protein, 7 aa, Artificial Sequence
  Synthetic
HTGHLLE

SEQ ID NO: 623 - protein, 7 aa, Artificial Sequence
  Synthetic
QSGHLTE

SEQ ID NO: 624 - protein, 7 aa, Artificial Sequence
  Synthetic
RSDKLTE

SEQ ID NO: 625 - protein, 7 aa, Artificial Sequence
  Synthetic
HRTTLTN

SEQ ID NO: 626 - protein, 7 aa, Artificial Sequence
  Synthetic
ERSHLRE

SEQ ID NO: 627 - protein, 7 aa, Artificial Sequence
  Synthetic
QLAHLRA

SEQ ID NO: 628 - protein, 7 aa, Artificial Sequence
  Synthetic
RSDHLTN

SEQ ID NO: 629 - protein, 7 aa, Artificial Sequence
  Synthetic
TSGHLVR

SEQ ID NO: 630 - protein, 7 aa, Artificial Sequence
  Synthetic
DPGHLVR

SEQ ID NO: 631 - protein, 7 aa, Artificial Sequence
  Synthetic
QRAHLER

SEQ ID NO: 632 - protein, 7 aa, Artificial Sequence
  Synthetic
RSDKLVR

SEQ ID NO: 633 - DNA, 53 bp, Artificial Sequence
  Synthetic
caaactaccacctacctccctcaccaaagcccataaaaataaaaaattataac

SEQ ID NO: 634 - DNA, 53 bp, Artificial Sequence
  Synthetic
gttataattttttatttttatgggctttggtgagggaggtaggtggtagtttg

SEQ ID NO: 635 - DNA, 57 bp, Artificial Sequence
  Synthetic
gactactcaaaaccatacctctcacttcaacctccctcaccattggcagcctagcat

SEQ ID NO: 636 - DNA, 57 bp, Artificial Sequence
  Synthetic
atgctaggctgccaatggtgagggaggttgaagtgagaggtatggttttgagtagtc

SEQ ID NO: 637 - protein, 23 aa, Artificial Sequence
  Synthetic
  misc_feature (12)..(18): Xaa can be any naturally occurring amino acid
FQCRICMRNFSXXXXXXXHIRTH

SEQ ID NO: 638 - protein, 23 aa, Artificial Sequence
  Synthetic
  misc_feature (12)..(18): Xaa can be any naturally occurring amino acid
FACDICGRKFAXXXXXXXHTKIH

SEQ ID NO: 639 - protein, 23 aa, Artificial Sequence
  Synthetic
  misc_feature (12)..(18): Xaa can be any naturally occurring amino acid
FQCDICMRNFSXXXXXXXHIRTH

SEQ ID NO: 640 - protein, 25 aa, Artificial Sequence
  Synthetic
  misc_feature (12)..(18): Xaa can be any naturally occurring amino acid
FQCDICMRKFAXXXXXXXHTKIHLR

SEQ ID NO: 641 - protein, 23 aa, Artificial Sequence
  Synthetic
  misc_feature (12)..(18): Xaa can be any naturally occurring amino acid
FQCRICMRNFSXXXXXXXHIRTH

SEQ ID NO: 642 - protein, 23 aa, Artificial Sequence
  Synthetic
  misc_feature (12)..(18): Xaa can be any naturally occurring amino acid
FACDICGRNFAXXXXXXXHTKIH

SEQ ID NO: 643 - protein, 25 aa, Artificial Sequence
  Synthetic
  misc_feature (12)..(18): Xaa can be any naturally occurring amino acid
FQCRICMRNFAXXXXXXXHTKIHLR

SEQ ID NO: 644 - protein, 25 aa, Artificial Sequence
  Synthetic
  misc_feature (12)..(18): Xaa can be any naturally occurring amino acid
FQCDICMRNFAXXXXXXXHTKIHLR

SEQ ID NO: 645 - DNA, 40 bp, Artificial Sequence
  Synthetic
caaactaccacctacctccctcaccattggcagcctagca

SEQ ID NO: 646 - DNA, 40 bp, Artificial Sequence
  Synthetic
tgctaggctgccaatggtgagggaggtaggtggtagtttg

The invention claimed is:

1. A base editor comprising a heterodimer having first and second monomers, said first monomer comprising a first programmable DNA binding protein and an N-terminal fragment of a split double-stranded DNA deaminase, and said second monomer comprising a second programmable DNA binding protein and a C-terminal fragment of a split double-stranded DNA deaminase, wherein dimerization of the first and second monomers reconstitutes the double-stranded DNA deaminase activity, wherein the N-terminal fragment of the split double-stranded DNA deaminase domain comprises an amino acid sequence having at least 90% sequence identity to SEQ ID NO: 349 or 351; and wherein the C-terminal fragment of the split double-stranded DNA deaminase domain comprises an amino acid sequence having at least 90% sequence identity to SEQ ID NO: 350 or 352.

2. The base editor of claim 1, wherein the first and/or second programmable DNA binding protein is a nucleic acid programmable DNA binding protein (napDNAbp), a TALE protein, a zinc finger protein, or a mitoTALE protein.

3. The base editor of claim 1, wherein the first monomer comprises a linker that joins the first programmable DNA binding protein with the N-terminal fragment of the split double-stranded DNA deaminase, and wherein the second monomer comprises a linker that joins the second programmable DNA binding protein with the C-terminal fragment of the split double-stranded DNA deaminase.

4. The base editor of claim 1 further comprising one or more uracil glycosylase inhibitor (UGI) domains.

5. The base editor of claim 1 further comprising one or more targeting sequences.

6. The base editor of claim 5, wherein the one or more targeting sequences is a nuclear localization sequence (NLS) or a mitochondrial targeting sequence (MTS).

7. The base editor of claim 6, wherein the MTS comprises an amino acid sequence selected from the group consisting of: SEQ ID NOs: 13, 14, and 299, or an amino acid sequence having at least 90% sequence identity to SEQ ID NOs: 13, 14, or 299.

8. The base editor of claim 1, wherein the first and/or second monomers have one of the following structures:

(a) [A]-[programmable DNA binding protein]-[N-terminal or C-terminal fragment of a split double-stranded DNA deaminase]-[B]; or (b) [A]-[N-terminal or C-terminal fragment of a split double-stranded DNA deaminase]-[programmable DNA binding protein]-[B], wherein "[A]" and/or "[B]" represent optional one or more additional functional domains; and wherein "]-[" is an optional linker.

9. The base editor of claim 1, wherein the first monomer comprises one of the following structures: [SOD2 MTS]-uracil glycosylase inhibitor $(UGI)_{1-2}$-[mitoTALE]-[$DddA_{tox}$-N of SEQ ID NO: 349 or $DddA_{tox}$-C of SEQ ID NO: 350]-$[UGI]_{1-2}$ or [COX8A MTS]-$[UGI]_{1-2}$-[mitoTALE]-[$DddA_{tox}$-N of SEQ ID NO: 351 or $DddA_{tox}$-C of SEQ ID NO: 352]-$[UGI]_{1-2}$; and wherein the second monomer comprises one of the following structures: [SOD2 MTS]-$[UGI]_{1-2}$-[mitoTALE]-[$DddA_{tox}$-N of SEQ ID NO: 349 or $DddA_{tox}$-C of SEQ ID NO: 350]-$[UGI]_{1-2}$ or [COX8A MTS]-$[UGI]_{1-2}$-[mitoTALE]-[$DddA_{tox}$-N of SEQ ID NO: 351 or $DddA_{tox}$-C of SEQ ID NO: 352]-$[UGI]_{1-2}$.

10. The base editor of claim 9, wherein the first monomer comprises an amino acid sequence having at least 90% sequence identity to SEQ ID NO: 360 or 361, and wherein the second monomer comprises an amino acid sequence having at least 90% sequence identity to SEQ ID NO: 360 or 361.

11. The base editor of claim 9, wherein the first monomer comprises an amino acid sequence having at least 95% sequence identity to SEQ ID NO: 360 or 361, and wherein the second monomer comprises an amino acid sequence having at least 95% sequence identity to SEQ ID NO: 360 or 361.

12. The base editor of claim 9, wherein the first monomer comprises the amino acid sequence of SEQ ID NO: 360 or 361, and wherein the second monomer comprises the amino acid sequence of SEQ ID NO: 360 or 361.

13. The base editor of claim 1, wherein the first and second monomers bind to first and second nucleotide sequences, respectively, on either side of a target site; and wherein the target site comprises a target base that becomes deaminated by the base editor.

14. A method of editing a target nucleotide sequence at a target site comprising contacting a target nucleotide sequence with the base editor of claim 1, wherein the first monomer targets a first nucleotide sequence flanking a target site, and the second monomer targets a second nucleotide sequence flanking the target site, thereby inducing deamination of a target base at the target site.

15. The base editor of claim 1, wherein the N-terminal fragment of the split double-stranded DNA deaminase domain comprises an amino acid sequence having at least 95% sequence identity to SEQ ID NO: 349 or 351; and wherein the C-terminal fragment of the split double-stranded DNA deaminase domain comprises an amino acid sequence having at least 95% sequence identity to SEQ ID NO: 350 or 352.

16. The base editor of claim 1, wherein the N-terminal fragment of the split double-stranded DNA deaminase domain comprises the amino acid sequence of SEQ ID NO: 349 or 351; and wherein the C-terminal fragment of the split double-stranded DNA deaminase domain comprises the amino acid sequence of SEQ ID NO: 350 or 352.

17. The base editor of claim 1, wherein the N-terminal fragment of the split double-stranded DNA deaminase domain comprises the amino acid sequence of SEQ ID NO: 349; and wherein the C-terminal fragment of the split double-stranded DNA deaminase domain comprises the amino acid sequence of SEQ ID NO: 350.

18. The base editor of claim 1, wherein the N-terminal fragment of the split double-stranded DNA deaminase domain comprises the amino acid sequence of SEQ ID NO: 351; and wherein the C-terminal fragment of the split double-stranded DNA deaminase domain comprises the amino acid sequence of SEQ ID NO: 352.

* * * * *